(12) United States Patent
Myomoto et al.

(10) Patent No.: US 8,945,849 B2
(45) Date of Patent: Feb. 3, 2015

(54) METHOD FOR DIAGNOSING ESOPHAGEAL CANCER

(75) Inventors: Akira Myomoto, Kanagawa (JP); Satoko Kozono, Kanagawa (JP); Hideo Akiyama, Kanagawa (JP); Hitoshi Nobumasa, Kanagawa (JP); Yutaka Shimada, Kyoto (JP); Gozoh Tsujimoto, Kyoto (JP)

(73) Assignees: Toray Industries, Inc., Tokyo (JP); Kyoto University, Kyoto (JP)

( * ) Notice: Subject to any disclaimer, the term of this patent is extended or adjusted under 35 U.S.C. 154(b) by 144 days.

(21) Appl. No.: 12/993,792

(22) PCT Filed: May 21, 2009

(86) PCT No.: PCT/JP2009/059323
§ 371 (c)(1),
(2), (4) Date: Nov. 19, 2010

(87) PCT Pub. No.: WO2009/142257
PCT Pub. Date: Nov. 26, 2009

(65) Prior Publication Data
US 2011/0098185 A1  Apr. 28, 2011

(30) Foreign Application Priority Data
May 21, 2008 (JP) ................................ 2008-133491

(51) Int. Cl.
*C12Q 1/68* (2006.01)
*G01N 33/574* (2006.01)

(52) U.S. Cl.
CPC ........ *C12Q 1/6886* (2013.01); *G01N 33/57446* (2013.01); *C12Q 2600/158* (2013.01)
USPC .......................... 435/6.14; 435/6.11; 435/6.18

(58) Field of Classification Search
None
See application file for complete search history.

(56) References Cited

U.S. PATENT DOCUMENTS 5,990,299 A * 11/1999 Ruzdijic et al. .............. 536/24.5
2007/0026424 A1   2/2007 Powell et al.
2007/0218512 A1   9/2007 Strongin et al.

FOREIGN PATENT DOCUMENTS

| EP | 1 897 940 A1 | 3/2008 |
|---|---|---|
| WO | WO 01/74405 A1 | 10/2001 |
| WO | WO 2006/118308 A1 | 11/2006 |
| WO | WO 2009/108706 A2 | 9/2009 |

OTHER PUBLICATIONS

Min et al. BMC Genomics. 2010. 11:96.*
Palmer et al. BMC Genomics. 2006. 7:115.*
Saetre et al. Molecular Brain Research. 2004. 126: 198-206.*
Liu et al. Clinical Immunology. 2004. 112: 225-230.*
Coleman et al. Drug Discovery Today. 2003. 8: 233-235.*
GeneCard for EYA2, available via url: < genecards.org/cgi-bin/card-disp.pl?gene=EYA2>, printed Aug. 1, 2012.*
GeneCard for SERF1A, available via url: < genecards.org/cgi-bin/carddisp.pl?gene=SERF1A>, printed Aug. 1, 2012.*
GeneCard for IGHG1, available via url:< genecards.org/cgi-bin/carddisp.pl?gene=IGHG1>, printed Aug. 1, 2012.*
Dahlberg et al. Ann Thorac Surg. 2004. 77: 1008-1015.*
Singh et al. Proceedings of the New Zealand Society of Animal Production. 2004. 64: 8-10.*
A. Luo et al.; Oncogene, 2004, vol. 23, No. 6, pp. 1291-1299.
Gozo Tsujimoto, Health and Labour Sciences Research Grants (Research on Advanced Medical Technology), 2007 pp. 10-12.
H. Kawamata et al.; Cancer Sci., 2003, vol. 94, No. 8, pp. 699-706.
H. Zhi et al.; Int. J. Cancer, 2003, vol. 106, No. 3, pp. 327-333.
Hideo Akiyama et al.; Bio Industry, 2008, vol. 25, No. 5, pp. 78-84.
L. Zhang et al.; Cancer Research, 2005, vol. 65, pp. 925-932.
Y. Ebihara et al.; British Journal of Cancer, 2004, vol. 91, No. 1, pp. 119-123.
Z. Chen et al.; FASEB Journal; 2007, vol. 21, pp. 2931-2938.
Ando et al., "Decreased expression of NDRG1 is correlated with tumor progression and poor prognosis in patients with esophageal squamous cell carcinoma", AACR Meeting Abstracts Online, Proc. Amer. Assoc. Cancer Res., vol. 47, 2006, abstract only.
Ji et al., "Differential expression of S100 gene family in human esophageal squamous cell carcinoma", J. Cancer Res. Clin. Oncol., vol. 130, pp. 480-486, 2004, XP002646198 (Published online Jun. 4, 2004).
Supplementary European Search Report, dated Jul. 13, 2011, for European Application No. 09750619.0.

* cited by examiner

*Primary Examiner* — Carla Myers
(74) *Attorney, Agent, or Firm* — Birch, Stewart, Kolasch & Birch, LLP

(57) ABSTRACT

This invention relates to a composition, kit, or DNA chip for use in diagnosis of esophageal cancer, which comprises a plurality of polynucleotides selected from the group consisting of polynucleotides whose expression levels are varied in esophageal cancer tissues obtained from esophageal cancer patients when compared with cancer-free esophageal tissues obtained from esophageal cancer patients, mutants thereof, and fragments thereof, and to a method for detecting esophageal cancer using the composition, kit, or DNA chip.

8 Claims, 6 Drawing Sheets

METHOD FOR DIAGNOSING ESOPHAGEAL CANCER

FIELD OF THE INVENTION

The present invention relates to a composition useful for diagnosing (determining or detecting) esophageal cancer, a method for detecting or determining esophageal cancer using the composition, and a kit for diagnosing or detecting esophageal cancer using the composition.

BACKGROUND OF THE INVENTION

The esophagus is a luminal organ that connects the pharynges and the stomach. The major parts thereof are present in the thoracic cavity, and some parts are present in the cervical region and in the abdominal cavity. In the upper portion of the thoracic cavity, the esophagus is located between the trachea and the spine, and it is surrounded by the heart, the aorta, and the lungs in the lower portion. The esophagus delivers food ingested via the mouth to the stomach.

In 2001, the cancer mortality was 238.8 out of 100,000 patients in Japan. The percentages of total deaths accounted for by esophageal cancer have been increasing every year. In fiscal 2001, 5.0% of the male patients who died of cancer died of esophageal cancer, and 1.4% of such female patients died of esophageal cancer. The peak ages for the onset of esophageal cancer are in the 60s to 70s, and males are more likely to develop esophageal cancer. Also, environmental factors such as smoking, drinking, or preference for hot foods are closely related to the development of esophageal cancer. Further, it is known that blood vessels and lymph ducts are abundant in or around the esophageal wall and thus a cancer developed in the esophargus often metastasizes.

Methods for treating esophageal cancer are determined in accordance with the degree of progress (the Japan Esophageal Society (ed.), Clinical Pathology: Rules for Treating Esophageal Cancer, 1999), metastasis, and general medical conditions. The standard method for treating esophageal cancer is described in "Guidelines for Treating Esophageal Cancer" (the Japan Esophageal Society, 2002). At present, the most common treatment method is surgery. The esophagus, including the cancerous portion, and surrounding tissues, including lymph glands, are excised (i.e., lymph node dissection), and thereafter the esophagus is reconstructed using other organs, such as stomach. Surgery, particularly extensive regional lymph node dissection, imposes serious burdens upon patients, and thus, lowered QOL after surgery should be an issue of concern. The early-stage cancer that remains in the mucosa may be occasionally treated by endoscopic demucosation. Also, radiation therapy may be occasionally carried out for both radical cures and symptomatic therapy. Further, chemotherapy may be carried out in combination with surgery or radiation therapy. At present, use of 5-fluorouracil in combination with cisplatin is considered to be the most effective chemotherapy.

Esophageal cancer is often found by consultation with a patient who has noticed symptoms, such as discomfort while swallowing, swallowing difficulty, retrosternal pain, or chest discomfort. These symptoms, however, occur as a result of the growth of cancer in the esophagus, and the cancer, which is found at the time of consultation following self-examination, has already progressed or metastasized outside the esophageal wall, and such a cancer often indicates a poor prognosis.

Esophageal cancer is definitely diagnosed by the imaging test, endoscopy, and biopsy in the esophargus. Biopsy specimens are collected at the time of endoscopy or surgery, pathological specimens are prepared, and the diagnosis is made on the basis of the histopathological classification. Accordingly, there is a demand on development of a simple, rapid diagnosis technique that can predict the presence or absence of esophageal cancer based on the properties of cells obtained by endoscopy.

Until now, the molecular-biological diagnosis technique that involves the use of markers contained specifically in esophageal cancer tissues has been proposed, and this technique can rapidly produce objective results and assist rapid diagnosis.

As the markers for clinical diagnosis of esophageal cancer, serum protein markers, such as SCC, CYFRA21-1, and CEA, have been used so far. Besides them, proteins as described in JP Patent Publication (kokai) No. 2003-259872 A and JP Patent Publication (kohyo) No. 2000-511536 A have also been reported. However, these markers have poor sensitivity and specificity, and the sensitivity of CYFRA21-1, which is likely to have the highest sensitivity, is as low as about 33.9% (Nakamura, T. et al., 1998, Diseases of the Esophagus, vol. 11, pp. 35-39) to about 43.9% (Kawaguchi, H. et. al., 2000, Cancer, vol. 89, pp. 1413-1417). Thus, this technique has not yet enabled to determine the presence or absence of esophageal cancer cells by detecting the serum markers alone or in combination.

As another marker that utilizes genes for specifically determining whether or not a biopsy sample from a subject contains esophageal cancer cells, use of chromosome aberration (see, for example, JP Patent Publication (kokai) No. 2001-17200 A and JP Patent Publication (kokai) No. 2002-272497 A) and epigenetic sequences of genes (e.g., JP Patent Publication (kohyo) No. 2004-505612 A) has been disclosed. Also, a plurality of results of the exhaustive analysis of gene expression using a DNA chip have been reported (see, for example, WO 2006/118308; Luo, A. et al., 2004, Oncogene, vol. 23, pp. 1291-1299; Zhi, H. et al., 2003, International Journal of Cancer, vol. 106, pp. 327-333; Lu, J. et al., 2001, International Journal of Cancer, vol. 91, pp. 288-294; Kazemi-Noureini, S. et al., 2004, World Journal of Gastroenterology, vol. 10, pp. 1716-1721; Xu, S. H. et al., 2003, World Journal of Gastroenterology, vol. 9, pp. 417-422; and Su, H. et al., 2003, Cancer Research, vol. 63, pp. 3872-3876). WO 2006/118308, in particular, provides 20 types of genes that determine the presence or absence of esophageal cancer cells by performing detection techniques in combination. In this technique, however, whether or not the samples contain esophageal cancer cells is determined with the use of different machines, which complicates the diagnosis. When one of the machines predicts that the sample contains esophagal cancer cells but the other machine predicts that the sample dose not contain esophageal cancer cells, also, diagnosis may occasionally become impossible. Furthermore, examples of the reported markers that utilize a single gene expression as an indicator include: the SPRR3 gene (Small proline-rich protein 3) as described in WO 2003/042661, Chen, B. S. et al., 2000, Carcinogenesis, vol. 21, pp. 2147-2150, and Abraham, J. M. et al., 1996, Cell Growth & Differentiation, vol. 7, pp. 855-860, the fgf3 gene as described in Kitagawa, Y. et al., 1991, Cancer Research, vol. 51, pp. 1504-1508, the CSTB gene (cystatin B, liver thiol proteinase inhibitor) as described in Xu, S. H. et al., 2003, World Journal of Gastroenterology, vol. 9, pp. 417-422 and Shiraishi, T. et al., 1998, International Journal of Cancer, vol. 79, pp. 175-178, the UCP2 gene (mitochondrial uncoupling protein 2) and the COL3A1 gene (3' region for pro-alpha(III) collagen) as described in WO 2003/076594; the UPK1A gene (uroplakin 1A) as described in WO 2003/042661; and the HSPA1B gene (heat shock 70 kDa protein 1) as described in Kawanishi, K. et al., 1999, Cancer, vol. 85, pp. 1649-1657. As markers for epithelial malignant tumors, the RRM1 gene (ribonucleotide reductase M1 polypeptide) and the like as disclosed in WO 2006/119464 are known. However, use thereof is not sufficient for the diagnosis of the presence or absence of esophageal cancer.

SUMMARY OF THE INVENTION

Problems to be Solved by the Invention

The aforementioned known indicators, however, are disadvantageously poor in specificity and/or sensitivity. Also, a method for effectively detecting such indicators from biological samples has not yet been established. For these reasons, the indicators are not generally used in the clinical field. Accordingly, development of markers for esophageal cancer with high specificity and sensitivity has been desired strongly.

An object of the invention is to provide a composition for determining a disease useful for diagnosis and treatment of esophageal cancer, a method for determining (or detecting) esophageal cancer using the composition, and a kit for determining (or detecting or diagnosing) esophageal cancer using the composition.

Means for Solving Problems

Examples of methods for searching for markers include: a method wherein gene expression levels, protein expression levels, or amounts of cellular metabolites in esophageal cancer cells and in non-cancerous cells obtained from a patient at the time of surgery are compared via a certain means; and a method wherein the amounts of genes, proteins, or metabolites contained in the body fluids of an esophageal cancer patient and of a non-cancerous patient are measured.

In recent years, DNA-array-based analysis of gene expression levels has been commonly used as a method for searching for markers. On a DNA array, probes that utilize nucleotide sequences corresponding to several hundreds to several tens of thousands of gene species are immobilized. When samples to be tested are applied to such a DNA array, genes contained in the samples bind to probes, and the amount of the binding may be measured via a certain means to determine the amounts of genes in the samples. Genes corresponding to the probes immobilized on a DNA array can be freely selected. Also, the gene expression levels in the samples may be compared with the use of esophageal cancer cells and non-cancerous cells obtained from a patient at the time of surgery or endoscopy, so that genes that can function as markers for esophageal cancer can be deduced.

In order to solve the above problems, we analyzed the gene expression in esophageal cancer cells and in non-cancerous cells obtained from esophageal cancer patients at the time of surgery using a DNA chip, whereby we have now found genes that can be used as markers for detection of esophageal cancer, and we have further found that the expression levels of such genes in the esophageal cancer cells were decreased or increased compared with those in the non-cancerous cells. This has led to the completion of the present invention.

1. SUMMARY OF THE INVENTION

The present invention includes the following characteristics.

In the first aspect, the present invention provides a composition for diagnosis of esophageal cancer comprising at least 3 polynucleotides selected from the group consisting of polynucleotides (a) to (e), mutants thereof, and fragments thereof.

(a) A polynucleotide consisting of the nucleotide sequence as shown in any of SEQ ID NOs: 1 to 38, a mutant thereof, or a fragment thereof comprising at least 15 continuous nucleotides;

(b) a polynucleotide comprising the nucleotide sequence as shown in any of SEQ ID NOs: 1 to 38;

(c) a polynucleotide consisting of a nucleotide sequence complementary to the nucleotide sequence as shown in any of SEQ ID NOs: 1 to 38, a mutant thereof, or a fragment thereof comprising at least 15 continuous nucleotides;

(d) a polynucleotide comprising a nucleotide sequence complementary to the nucleotide sequence as shown in any of SEQ ID NOs: 1 to 38; and (e) a polynucleotide hybridizing, under stringent conditions, to any of polynucleotides (a) to (d) or a fragment thereof comprising at least 15 continuous nucleotides.

According to another embodiment, in the composition, the fragment is a polynucleotide comprising at least 60 continuous nucleotides.

According to another embodiment, in the composition, the fragment is a polynucleotide comprising the nucleotide sequence as shown in any of SEQ ID NOs: 63 to 100 and comprising at least 60 continuous nucleotides in the nucleotide sequence as shown in any of SEQ ID NOs: 1 to 38, or a polynucleotide comprising a nucleotide sequence complementary thereto.

According to another embodiment, in the composition, the fragment is a polynucleotide comprising the nucleotide sequence as shown in any of SEQ ID NOs: 63 to 100, or a nucleotide sequence complementary thereto.

According to another embodiment, the composition further comprises at least 2 polynucleotides selected from the group consisting of polynucleotides (f) to (j), mutants thereof, and fragments thereof.

(f) A polynucleotide consisting of the nucleotide sequence as shown in any of SEQ ID NOs: 39 to 62, a mutant thereof, or a fragment thereof comprising at least 15 continuous nucleotides;

(g) a polynucleotide comprising the nucleotide sequence as shown in any of SEQ ID NOs: 39 to 62;

(h) a polynucleotide consisting of a nucleotide sequence complementary to the nucleotide sequence as shown in any of SEQ ID NOs: 39 to 62, a mutant thereof, or a fragment thereof comprising at least 15 continuous nucleotides;

(i) a polynucleotide comprising a nucleotide sequence complementary to the nucleotide sequence as shown in any of SEQ ID NOs: 39 to 62; and (j) a polynucleotide hybridizing, under stringent conditions, to any of polynucleotides (f) to (i) or a fragment thereof comprising at least 15 continuous nucleotides.

According to another embodiment, in the composition, the fragment is a polynucleotide comprising at least 60 continuous nucleotides.

According to another embodiment, in the composition, the fragment is a polynucleotide comprising the nucleotide sequence as shown in any of SEQ ID NOs: 101 to 124 and comprising at least 60 continuous nucleotides in the nucleotide sequence as shown in any of SEQ ID NOs: 39 to 62, or a polynucleotide comprising a nucleotide sequence complementary thereto.

According to another embodiment, in the composition, the fragment is a polynucleotide comprising the nucleotide sequence as shown in any of SEQ ID NOs: 101 to 124, or a nucleotide sequence complementary thereto.

In the second aspect, the present invention provides a kit for diagnosis of esophageal cancer comprising at least 3 polynucleotides selected from the group consisting of polynucleotides (a) to (e), mutants thereof, and fragments thereof.

According to another embodiment, the kit further comprises at least 2 polynucleotides selected from the group consisting of polynucleotides (f) to (j), mutants thereof, and/or fragments thereof.

According to another embodiment, in the kit, the polynucleotide is a polynucleotide consisting of the nucleotide sequence as shown in any of SEQ ID NOs: 1 to 62, a polynucleotide consisting of a sequence complementary thereto, a polynucleotide hybridizing thereto under stringent conditions, or a fragment thereof comprising at least 15 continuous nucleotides.

According to another embodiment, in the kit, the fragment is a polynucleotide comprising at least 60 continuous nucleotides.

According to another embodiment, in the kit, the fragment is a polynucleotide comprising the nucleotide sequence as shown in any of SEQ ID NOs: 63 to 124 and comprising at least 60 continuous nucleotides in the nucleotide sequence as shown in any of SEQ ID NOs: 1 to 62, or a polynucleotide comprising a nucleotide sequence complementary thereto.

According to another embodiment, in the kit, the fragment is a polynucleotide comprising the nucleotide sequence as shown in any of SEQ ID NOs: 63 to 124, or a nucleotide sequence complementary thereto.

According to another embodiment, in the kit, the fragment is a polynucleotide consisting of the nucleotide sequence as shown in any of SEQ ID NOs: 63 to 124.

According to another embodiment, the kit comprises at least 5 to all of the polynucleotides each comprising a nucleotide sequence as shown in any of SEQ ID NOs: 63 to 124 or a nucleotide sequence complementary thereto.

According to another embodiment, in the kit, the polynucleotides are packaged in different containers separately or, optionally, in combination.

According to another embodiment, the DNA chip for diagnosis of esophageal cancer comprises at least 3 polynucleotides selected from the group consisting of polynucleotides (a) to (e), a mutant thereof, and/or fragments thereof.

In the third aspect, the present invention provides a DNA chip comprising at least 2 polynucleotides selected from the group consisting of polynucleotides (f) to (j), mutants thereof, and/or fragments thereof.

According to another embodiment, the DNA chip comprises at least 5 to all of the polynucleotides each comprising a nucleotide sequence as shown in any of SEQ ID NOs: 63 to 124 or a nucleotide sequence complementary thereto.

In the fourth aspect, the present invention provides a method for in vitro determining whether or not a test sample from a subject contains esophageal cancer cells by measuring the expression level of the target nucleic acid in a biological sample from a subject using any of the above compositions, any of the above kits, any of the above DNA chips, or a combination thereof.

According to another embodiment, the method comprises the use of a DNA chip.

According to another embodiment, the method for determining esophageal cancer comprises the steps of:

(1) measuring in vitro expression levels of the target nucleic acids in a plurality of biological samples that are known to be tissues comprising esophageal cancer cells using any of the above compositions, any of the above kits, any of the above DNA chips, or a combination thereof;

(2) preparing a discriminant (i.e., a support vector machine) made using as training samples the expression levels of the target nucleic acids determined in step (1);

(3) measuring in vitro expression levels of the target nucleic acids in a test sample from the esophagus of the subject in the same manner as in step (1); and (4) assigning the expression levels of the target nucleic acids determined in step (3) to the discriminant prepared in step (2), thereby determining whether or not the test sample from the subject comprises esophageal cancer cells, based on the results obtained from the discriminant.

In another embodiment, the present invention provides use of any of the above compositions, any of the above kits, any of the above the DNA chips, for in vitro prediction of the presence or absence of esophageal cancer.

In another embodiment, the present invention provides a method for in vitro predicting the presence or absence of esophageal cancer of a subject by using at least 3 antibodies against polypeptides encoded by the nucleotide sequences as shown in SEQ ID NOs: 1 to 38 or fragments thereof to in vitro measure the levels of the polypeptides in the esophageal cancer cells or blood from a subject.

In another embodiment, the method further comprises using at least 2 antibodies against polypeptides encoded by the nucleotide sequences as shown in SEQ ID NOs: 39 to 62 or fragments thereof to measure the levels of the polypeptides.

According to another embodiment, in the method, the polypeptides comprise the amino acid sequences as shown in SEQ ID NOs: 125 to 186.

According to another embodiment, in the method, the subject is determined to have esophageal cancer when the expression levels of the polypeptides in the subject suffering from esophageal cancer are varied compared with those in a healthy subject.

2. DEFINITION

The terms as used herein have the definitions as set forth below.

The meanings of terms such as nucleotide, polynucleotide, amino acid, peptide, polypeptide, and protein, and their abbreviations are in accordance with the "GUIDELINES FOR THE PREPARATION OF SPECIFICATION WHICH CONTAIN NUCLEOTIDE AND/OR AMINO ACID SEQUENCE" (edited by Japan Patent Office) and common usage in the art.

The term "polynucleotide" as used herein refers to a nucleic acid including each of RNA and DNA. Such DNA includes cDNA, genomic DNA, and synthetic DNA. Such RNA includes total RNA, mRNA, rRNA, and synthetic RNA. The term "polynucleotide" is used interchangeably with the term "nucleic acid."

The term "cDNA" as used herein is intended to comprise a full-length DNA strand of a sequence complementary to RNA resulting from gene expression, or a DNA fragment consisting of a partial sequence thereof. cDNA can be synthesized via reverse transcription-polymerase chain reaction (RT-PCR) using RNA as a template and a poly T primer.

The term "gene" as used herein refers to not only double-stranded DNA but also single-stranded DNA such as a plus-strand (or a sense strand) or a complementary strand (or an antisense strand), which strands constitute double-stranded DNA. It is not particularly limited by the length of such strand.

Accordingly, the term "gene" as used herein is intended to comprise any of double-stranded DNA (including human genomic DNA), single-stranded DNA (plus-strand) (including cDNA), single-stranded DNA having a sequence complementary to the plus-strand (complementary strand), and a fragment thereof, unless otherwise specified. Such "gene" includes not only a "gene" represented by a specific nucleotide sequence (or a SEQ ID NO.) but also another "gene" encoding a protein, which has a biological function equivalent to that of a protein encoded by the gene, such as a homolog, a mutant such as a splice variant, and a derivative. Specific examples of the "genes" encoding such homolog, mutant, or derivative include "genes" each having a nucleotide sequence hybridizing to a sequence complementary to a specific nucleotide sequence as shown in any of SEQ ID NOs: 1 to 62 under stringent conditions as described below.

Examples of human-derived protein homologs or genes encoding the same include proteins or genes derived from other organism species corresponding to the human proteins or human genes encoding the same. Such protein homologs or gene homologs can be identified by HomoloGene, which is available through NIH via the internet. Specifically, a certain human amino acid or nucleotide sequence can be subjected to the BLAST programs, available through NIH via the internet (see Karlin, S. et al., Proceedings of the National Academic Sciences, U.S.A., 1993, vol. 90, pp. 5873-5877, to obtain the accession number of the corresponding sequence (i.e., the sequence exhibiting the highest score, E-value 0, and identity 100%). Examples of the known BLAST programs include BLASTN (gene) and BLASTX (protein). When searching for a gene, for example, the accession number obtained from the above-mentioned BLAST search is inputted into the Uni-Gene program, available through NIH via the internet, and the obtained UniGeneClusterID (the number identified with "Hs.") is then inputted into the HomoloGene. From the list that shows the correlation of gene homologs between the genes of other organism species and the human genes, a gene of the other organism species can be selected as a gene homolog corresponding to the human gene represented by a given nucleotide sequence. In this procedure, the FASTA program, available through NIH via the internet, may be used instead of the BLAST program.

Functional regions of "genes" are not limited, and examples thereof include expression-control regions, coding regions, and exon or intron regions.

The term "transcription product" as used herein refers to messenger RNA (mRNA), which is synthesized from the DNA sequence of a gene as a template. Messenger RNA is synthesized via binding of RNA polymerase to a site called promoter, which is located upstream of the gene of interest, and subsequently via binding of ribonucleotides to the 3' end, so as to be complementary to the nucleotide sequence of DNA. Such messenger RNA can comprise not only the gene of interest but also a full-length sequence spanning from a transcription initiation site to the terminus of a poly A sequence including an expression control region, coding region, and exon or intron region.

The term "translation product" as used herein refers to a protein, which is synthesized based on the information of messenger RNA synthesized via transcription regardless of modification such as splicing. During the translation process of messenger RNA, ribosome first binds to messenger RNA, and amino acids are then linked in accordance with the nucleotide sequence of messenger RNA, thereby leading to the synthesis of a protein.

The term "probe" as used herein is intended to comprise a polynucleotide used for specifically detecting RNA resulting from gene expression or a polynucleotide derived therefrom and/or a polynucleotide complementary thereto.

The term "primer" as used herein refers to a continuous polynucleotide that specifically recognizes and amplifies RNA resulting from gene expression or a polynucleotide derived therefrom and/or a polynucleotide complementary thereto.

The complementary polynucleotide (i.e., a complementary strand or reverse strand) refers to a polynucleotide that is basically complementary to the full-length sequence of a polynucleotide having a nucleotide sequence as shown in a given SEQ ID NO. or a partial sequence thereof (herein, conveniently referred to as a "plus strand"), on the basis of the base pairing like A:T(U) or G:C. Such a complementary strand, however, is not limited to a sequence completely complementary to the nucleotide sequence of a plus strand of interest; that is, the complementary strand may have such a complementarity to an extent that it can hybridize to the plus strand under stringent conditions.

As used herein, the "stringent conditions" means such conditions that a probe can hybridize to a target sequence with a higher degree of detection when compared with its hybridization to other sequences (e.g., at least twice the background). Stringent conditions are dependent on the sequence of a target, and conditions vary depending on the environment where hybridization takes place. By controlling stringency of hybridization and/or washing conditions, a target sequence that is 100% complementary to the probe can be identified.

As used herein, the term "mutant" in case of a nucleic acid refers to a naturally-occurring mutant resulting from polymorphism, mutation, alternative splicing during transcription, a mutant based on degeneracy of genetic cord, a mutant comprising a deletion, substitution, addition, or insertion of one or more nucleotides, preferably one or several nucleotides, in the nucleotide sequence as shown in any of SEQ ID NOs: 1 to 62 or a partial sequence thereof, a mutant having at least about 80%, at least about 85%, at least about 90%, at least about 95%, at least about 97%, at least about 98%, or at least about 99% identity with the nucleotide sequence or the partial sequence thereof, or a nucleic acid mutant that hybridizes to a polynucleotide or oligonucleotide comprising the nucleotide sequence or the partial sequence thereof under the stringent conditions as defined above. On the other hand, a "mutant" in case of a protein or peptide refers to a mutant comprising a deletion, substitution, addition, or insertion of one or more amino acids, preferably one or several amino acids, in an amino acid sequence as shown in any of SEQ ID NOs: 125 to 186 or a partial sequence thereof, or a mutant having a % identity of at least about 80%, at least about 85%, at least about 90%, at least about 95%, at least about 97%, at least about 98%, or at least about 99% with the amino acid sequence or the partial sequence thereof.

The term "several" as used herein means an integer of about 10, 9, 8, 7, 6, 5, 4, 3, or 2.

As used herein, the "% identity" can be determined by using a protein or gene searching system such as BLAST or FASTA as mentioned above, with or without introduction of a gap (Karlin, S. et al., 1993, Proceedings of the National Academic Sciences, U.S.A., vol. 90, pp. 5873-5877; Altschul, S. F. et al., 1990, Journal of Molecular Biology, vol. 215, pp. 403-410; Pearson, W. R. et al., 1988, Proceedings of the National Academic Sciences, U.S.A., vol. 85, pp. 2444-2448).

As used herein, the term "derivative" in case of a nucleic acid refers to a derivative labeled with fluorophore or the like, a derivative comprising a modified nucleotide (e.g., a nucleotide having a group such as halogen, alkyl (e.g., methyl), alkoxy (e.g., methoxy), thio, or carboxymethyl; or a nucleotide comprising reconstitution of a base, saturation of a double bond, deamination, or substitution of oxygen by sulfur), or the like. On the other hand, the term "derivative" in case of a protein refers to a chemically modified derivative, such as an acetylated, acylated, alkylated, phosphorylated, sulfated, glycosylated, or biotinized derivative.

As used herein, the term "a composition for diagnosis (or detection or determination)" refers to a composition that is directly or indirectly employed for diagnosing the presence or absence of or a degree of the onset or development of esophageal cancer or the presence or absence of or a degree of amelioration of esophageal cancer, or for screening for candidate substances useful for preventing, ameliorating, or treating esophageal cancer. The composition comprises a nucleotide, an oligonucleotide, or a polynucleotide, which can specifically recognize and bind to a gene whose expression varies or fluctuates in vivo, particularly in an esophagus tissue, in association with the development of esophageal cancer, or an antibody that can detect a protein as a translation product of the gene. Such nucleotide, oligonucleotide, or polynucleotide can be effectively used as a probe for detecting the aforementioned gene that is expressed in vivo, in a tissue, or in a cell, based on the aforementioned properties, or as a primer for amplifying the gene expressed in vivo.

As used herein, the term "biological tissue" to be detected or diagnosed refers to a tissue in which the expression pattern of the gene of the invention changes with the development of esophageal cancer. More specifically, the tissue means an esophageal tissue, peripheral lymph nodes, or another organ suspected of metastasis.

The term "EYA2 gene" or "EYA2" as used herein includes the eyes absent homolog 2 gene (or DNA) as shown in a given nucleotide sequence (i.e., SEQ ID NO: 1), a gene (or DNA) encoding HTG, PRKCBP1, RPS2, a homolog thereof, a mutant thereof, or a derivative thereof, or the like, unless it is defined by a SEQ ID NO. Specific examples include the EYA2 gene (GenBank Accession No. AL049540) as shown in SEQ ID NO: 1 and homologs thereof from other organism species. The EYA2 gene can be obtained by the method disclosed in Zimmerman J. E. et al., 1997, Genome Res., vol. 7, pp. 128-141.

The term "SERF1A gene" or "SERF1A" as used herein includes a the Small EDRK-rich factor 1 gene (or DNA) as shown in a given nucleotide sequence (i.e., SEQ ID NO: 2), gene (or DNA) encoding 4F5, H4F5, SMA modifier 1, a homolog thereof, a mutant thereof, or a derivative thereof, or the like, unless it is defined by a SEQ ID NO. Specific examples include the SERF1A gene (GenBank Accession No. AF073519) as shown in SEQ ID NO: 2 and homologs thereof from other organism species. The SERF1A gene can be obtained by the method disclosed in Scharf J. M., et al., 1998, Nat. Genet., vol. 20, pp. 83-86.

The term "IGHG1 gene" or "IGHG1" as used herein includes the immunoglobulin heavy constant gamma 1 gene (or DNA) as shown in a given nucleotide sequence (i.e., SEQ ID NO: 3), a gene (or DNA) encoding the G1m marker, FLJ39988, F1140036, FLJ40253, FLJ40587, F1140789, F1140834, MGC45809, DKFZp686H11213, a homolog thereof, a mutant thereof, or a derivative thereof, or the like, unless it is defined by a SEQ ID NO. Specific examples include the IGHG1gene (GenBank Accession No. NC_000014) as shown in SEQ ID NO: 3 and homologs thereof from other organism species. The IGHG1 gene can be obtained by the method disclosed in Hood L., et al., 1968, Nature, vol. 220, pp. 764-767.

The term "ITSN2 gene" or "ITSN2" as used herein includes the INTERSECTIN2 gene (or DNA) as shown in a given nucleotide sequence (i.e., SEQ ID NO: 4), a gene (or DNA) encoding SH3 domain-containing protein 1B, SH3P18, SH3P18-like WASP associated protein, a homolog thereof, a mutant thereof, or a derivative thereof, or the like, unless it is defined by a SEQ ID NO. Specific examples include the ITSN2 gene (GenBank Accession No. NM_019595) as shown in SEQ ID NO: 4 and homologs thereof from other organism species. The ITSN2 gene can be obtained by the method disclosed in Pucharcos C., et al., 2000, FEBS Lett., vol. 478, pp. 43-51.

The term "RAB11FIP5 gene" or "RAB11FIP5" as used herein includes the *Homo sapiens* RAB11 family interacting protein 5 (classI) gene (or DNA) as shown in a given nucleotide sequence (i.e., SEQ ID NO: 5), a gene (or DNA) encoding KIAA0853, RIP11, pp75, GAF1, DKFZP434H018, a homolog thereof, a mutant thereof, or a derivative thereof, or the like, unless it is defined by a SEQ ID NO. Specific examples include the RAB11FIP5 gene (GenBank Accession No. BC035013) as shown in SEQ ID NO: 5 and homologs thereof from other organism species. The RAB11FIP5 gene can be obtained by the method disclosed in Ito T., et al., 1999, J. Clin. Invest., vol. 104, pp. 1265-1275.

The term "HSPA1A gene" or "HSPA1A" as used herein includes the Heat shock 70 kDa protein 1A gene (or DNA) as shown in a given nucleotide sequence (i.e., SEQ ID NO: 6), a gene (or DNA) encoding HAPA1 (DNA), HSP70.1 (DNA), HSP70-1/HSP70-2 (DNA), HSPA1B (DNA), HSP72 (DNA), a homolog thereof, a mutant thereof, or a derivative thereof, or the like, unless it is defined by a SEQ ID NO. Specific examples include the HSPA1A gene (GenBank Accession No. NM_005345) as shown in SEQ ID NO: 6 and homologs thereof from other organism species. The HSPA1A gene can be obtained by the method disclosed in Ito T., et al., 1998, J. Biochem. (Tokyo), vol. 124, pp. 347-353.

The term "NMU gene" or "NMU" as used herein includes the neuromedin U precursor gene (or DNA) as shown in a given nucleotide sequence (i.e., SEQ ID NO: 7), a gene (or DNA) encoding neuromedin-U-25, NmU-25, a homolog thereof, a mutant thereof, or a derivative thereof, or the like, unless it is defined by a SEQ ID NO. Specific examples include the NMU gene (GenBank Accession No. NM_006688) as shown in SEQ ID NO: 7 and homologs thereof from other organism species. The NMU gene can be obtained by the method disclosed in Austin U., et al., 1995, J. Mol. Endocrinol., vol. 14, pp. 157-169.

The term "E2F3 gene" or "E2F3" as used herein includes the E2F transcription factor 3 gene (or DNA) as shown in a given nucleotide sequence (i.e., SEQ ID NO: 8), a gene (or DNA) encoding E2F-3, a homolog thereof, a mutant thereof, or a derivative thereof, or the like, unless it is defined by a SEQ ID NO. Specific examples include the E2F3 gene (GenBank Accession No. NM_001949) as shown in SEQ ID NO: 8 and homologs thereof from other organism species. The E2F3 gene can be obtained by the method disclosed in Lees J. A., et al., 1993, Mol. Cell. Biol., vol. 13, pp. 7813-7825.

The term "ESR2 gene" or "ESR2" as used herein includes the estrogen receptor beta gene (or DNA) as shown in a given nucleotide sequence (i.e., SEQ ID NO: 9), a gene (or DNA) encoding ER-BETA, Erb, NR3A2, a homolog thereof, a mutant thereof, or a derivative thereof, or the like, unless it is defined by a SEQ ID NO. Specific examples include the ESR2 gene (GenBank Accession No. NM_001437) as shown in SEQ ID NO: 9 and homologs thereof from other organism species. The ESR2 gene can be obtained by the method disclosed in Dotzlaw H., et al., 1997, J. Clin. Endocrinol. Metab., vol. 82, pp. 2371-2374.

The term "CFDP1 gene" or "CFDP1" as used herein includes the craniofacial development protein 1 gene (or DNA) as shown in a given nucleotide sequence (i.e., SEQ ID NO: 10), a gene (or DNA) encoding Bucentaur, BCNT, CP27, p97, SWC5, Yeti, a homolog thereof, a mutant thereof, or a derivative thereof, or the like, unless it is defined by a SEQ ID NO. Specific examples include the CFDP1 gene (GenBank Accession No. NM_006324) as shown in SEQ ID NO: 10 and homologs thereof from other organism species. The CFDP1 gene can be obtained by the method disclosed in Diekwisch T. G., et al., 1999, Gene, vol. 235, pp. 19-30.

The term "HSPC190 gene" or "HSPC190" as used herein includes the proapoptotic caspase adaptor protein gene (or DNA) as shown in a given nucleotide sequence (i.e., SEQ ID NO: 11), a gene (or DNA) encoding caspase-2 binding protein, MGC29506, a homolog thereof, a mutant thereof, or a derivative thereof, or the like, unless it is defined by a SEQ ID NO. Specific examples include the HSPC190 gene (GenBank Accession No. NM_016459) as shown in SEQ ID NO: 11 and homologs thereof from other organism species. The HSPC190 gene can be obtained by the method disclosed in Katoh M., et al., 2003, Int. J. Oncol., vol. 23, pp. 235-241.

The term "COL1A2 gene" or "COL1A2" as used herein includes the collagen alpha-2(I) chain precursor gene (or DNA) as shown in a given nucleotide sequence (i.e., SEQ ID NO: 12), a gene (or DNA) encoding alpha-2 type I collagen, a homolog thereof, a mutant thereof, or a derivative thereof, or the like, unless it is defined by a SEQ ID NO. Specific examples include the COL1A2 gene (GenBank Accession No. Z74616) as shown in SEQ ID NO: 12 and homologs thereof from other organism species. The COL1A2 gene can be obtained by the method disclosed in Mottes M., et al., 1998, Hum. Mutat., vol. 12, pp. 71-72.

The term "GCS1 gene" or "GCS1" as used herein includes the mannosyl-oligosaccharide glucosidase gene (or DNA) as shown in a given nucleotide sequence (i.e., SEQ ID NO: 13), a gene (or DNA) encoding processing A-glucosidase I, a homolog thereof, a mutant thereof, or a derivative thereof, or the like, unless it is defined by a SEQ ID NO. Specific examples include the GCS1 gene (GenBank Accession No. NM_006302) as shown in SEQ ID NO: 13 and homologs thereof from other organism species. The GCS1 gene can be obtained by the method disclosed in Kalz-Fuller B., et al., 1995, Eur. J. Biochem., vol. 231, pp. 344-351.

The term "PARL gene" or "PARL" as used herein includes the presenillins associated rhomboid-like protein gene (or DNA) as shown in a given nucleotide sequence (i.e., SEQ ID NO: 14), a gene (or DNA) encoding a homolog thereof, a mutant thereof, or a derivative thereof, or the like, unless it is defined by a SEQ ID NO. Specific examples include the PARL gene (GenBank Accession No. NM_018622) as shown in SEQ ID NO: 14 and homologs thereof from other organism species. The PARL gene can be obtained by the method disclosed in Pellegrini L., et al., 2001, J. Alzheimers Dis., vol. 3, pp. 181-190.

The term "CELSR2 gene" or "CELSR2" as used herein includes the cadherin EGF LAG seven-pass G-type receptor 2 precursor gene (or DNA) as shown in a given nucleotide sequence (i.e., SEQ ID NO: 15), a gene (or DNA) encoding epidermal growth factor-like 2, multiple epidermal growth factor-like domains 3, Flamingo 1, a homolog thereof, a mutant thereof, or a derivative thereof, or the like, unless it is defined by a SEQ ID NO. Specific examples include the CELSR2 gene (GenBank Accession No. NM_001408) as shown in SEQ ID NO: 15 and homologs thereof from other organism species. The CELSR2 gene can be obtained by the method disclosed in Nakayama M., et al., 1998, Genomics, vol. 51, pp. 27-34.

The term "NDRG1 gene" or "NDRG1" as used herein includes the N-myc downstream regulated gene 1 gene (or DNA) as shown in a given nucleotide sequence (i.e., SEQ ID NO: 16), a gene (or DNA) encoding GC4, RTP, NDR1, NMSL, TDD5, CAP43, CMT4D, HMSNL, RIT42, TARG1, PROXY1, a homolog thereof, a mutant thereof, or a derivative thereof, or the like, unless it is defined by a SEQ ID NO. Specific examples include the NDRG1 gene (GenBank Accession No. NM_006096) as shown in SEQ ID NO: 16 and homologs thereof from other organism species. The NDRG1 gene can be obtained by the method disclosed in Kokame K., et al., 1996, J. Biol. Chem., vol. 271, pp. 29659-29665.

The term "SLC25A44 gene" or "SLC25A44" as used herein includes the solute carrier family 25, member 44 gene (or DNA) as shown in a given nucleotide sequence (i.e., SEQ ID NO: 17), a gene (or DNA) encoding F1190431, KIAA0446, RP11-54H19.3, a homolog thereof, a mutant thereof, or a derivative thereof, or the like, unless it is defined by a SEQ ID NO. Specific examples include the SLC25A44 gene (GenBank Accession No. NM_014655) as shown in SEQ ID NO: 17 and homologs thereof from other organism species. The SLC25A44 gene can be obtained by the method disclosed in Haitina T., et al., 2006, Genomics, vol. 88, pp. 779-790.

The term "TUSC2 gene" or "TUSC2" as used herein includes the tumor suppressor candidate 2 gene (or DNA) as shown in a given nucleotide sequence (i.e., SEQ ID NO: 18), a gene (or DNA) encoding PAP, FUS1, PDAP2, C3orf11, a homolog thereof, a mutant thereof, or a derivative thereof, or the like, unless it is defined by a SEQ ID NO. Specific examples include the TUSC2 gene (GenBank Accession No. NM_007275) as shown in SEQ ID NO: 18 and homologs thereof from other organism species. The TUSC2 gene can be obtained by the method disclosed in Lerman M. I., et al., 2000, Cancer Res., vol. 60, pp. 6116-6133.

The term "SLC4A1 gene" or "SLC4A1" as used herein includes the Solute carrier family 4, anion exchanger, member 1 gene (or DNA) as shown in a given nucleotide sequence (i.e., SEQ ID NO: 19), a gene (or DNA) encoding DI, FR, SW, WD, WR, AE1, WD1, BND3, EPB3, CD233, EMPB3, RTA1A, MGC116753, MGC126619, MGC126623, a homolog thereof, a mutant thereof, or a derivative thereof, or the like, unless it is defined by a SEQ ID NO. Specific examples include the SLC4A1 gene (GenBank Accession No. NM_000342) as shown in SEQ ID NO: 19 and homologs thereof from other organism species. The SLC4A1 gene can be obtained by the method disclosed in Lux S. E., et al., 1189, Proc. Natl. Acad. Sci. U.S.A., vol. 86, pp. 9089-9093.

The term "MS4A7 gene" or "MS4A7" as used herein includes the Membrane-spanning 4-domains, sunfamily A, member 7 gene (or DNA) as shown in a given nucleotide sequence (i.e., SEQ ID NO: 20), a gene (or DNA) encoding CFFM4, MS4A8, 4SPAN2, CD20L4, MGC22368, a homolog thereof, a mutant thereof, or a derivative thereof, or the like, unless it is defined by a SEQ ID NO. Specific examples include the MS4A7 gene (GenBank Accession No. NM_206938) as shown in SEQ ID NO: 20 and homologs thereof from other organism species. The MS4A7 gene can be obtained by the method disclosed in Ishibashi K., et al., 2001, Gene, vol. 264, pp. 87-93.

The term "thymosin beta-4 gene" or "TMSB4X" as used herein includes the thymosin beta-4 gene (or DNA) as shown in a given nucleotide sequence (i.e., SEQ ID NO: 21), a gene (or DNA) encoding FX, TB4X, PTMB4, TMSB4, thymosin beta-4, X-linked, a homolog thereof, a mutant thereof, or a derivative thereof, or the like, unless it is defined by a SEQ ID NO. Specific examples include the TMSB4X gene (GenBank Accession No. NM_021109) as shown in SEQ ID NO: 21 and homologs thereof from other organism species. The TMSB4X gene can be obtained by the method disclosed in Gondo H. et al., 1987, J. Immunol., vol. 139, pp. 3840-3848.

The term "PRC1 gene" or "PRC1" as used herein includes the protein regulator of cytokinesis 1 gene (or DNA) as shown in a given nucleotide sequence (i.e., SEQ ID NO: 22), a gene (or DNA) encoding protein regulating cytokinesis 1, ASE1, MGC1671, MGC3669, a homolog thereof, a mutant thereof, or a derivative thereof, or the like, unless it is defined by a SEQ ID NO. Specific examples include the PRC1 gene (GenBank Accession No. NM_003981) as shown in SEQ ID NO: 22 and homologs thereof from other organism species. The PRC1 gene can be obtained by the method disclosed in Jiang W., et al., 1998, Mol. Cell., vol. 2, pp. 877-885.

The term "VCP gene" or "VCP" as used herein includes the Valosin-containing protein gene (or DNA) as shown in a given nucleotide sequence (i.e., SEQ ID NO: 23), a gene (or DNA) encoding p97, TERA, IBMPFD, MGC8560, MGC131997, MGC148092, a homolog thereof, a mutant thereof, or a derivative thereof, or the like, unless it is defined by a SEQ ID NO. Specific examples include the VCP gene (GenBank Accession No. NM_007126) as shown in SEQ ID NO: 23 and homologs thereof from other organism species. The VCP gene can be obtained by the method disclosed in Druck T., et al., 1995, Genomics, vol. 30, pp. 94-97.

The term "RBM9 gene" or "RBM9" as used herein includes the RNA binding motif protein 9 gene (or DNA) as shown in a given nucleotide sequence (i.e., SEQ ID NO: 24), a gene (or DNA) encoding RTA, fxh, Fox-2, HNRBP2, HRNBP2, dj106I20.3, a homolog thereof, a mutant thereof, or a derivative thereof, or the like, unless it is defined by a SEQ ID NO. Specific examples include the RBM9 gene (GenBank Accession No. NM_014309) as shown in SEQ ID NO: 24 and homologs thereof from other organism species. The RBM9 gene can be obtained by the method disclosed in Norris J. D., et al., 2002, Mol. Endocrinol., vol. 16, pp. 459-468.

The term "GPR126 gene" or "GPR126" as used herein includes the G protein-coupled receptor 126 gene (or DNA) as shown in a given nucleotide sequence (i.e., SEQ ID NO: 25), a gene (or DNA) encoding FLJ14937, DKFZp564D0462, VIGR, DREG, PS1TP2, a homolog thereof, a mutant thereof, or a derivative thereof, or the like, unless it is defined by a SEQ ID NO. Specific examples include the GPR126 gene (GenBank Accession No. BC075798) as shown in SEQ ID NO: 25 and homologs thereof from other organism species. The GPR126 gene can be obtained by the method disclosed in Stehlik C., et al., 2004, FEBS Lett., vol. 569, pp. 149-155.

The term "HOXA10 gene" or "HOXA10" as used herein includes the Homeobox A10 gene (or DNA) as shown in a given nucleotide sequence (i.e., SEQ ID NO: 26), a gene (or DNA) encoding HOX1.8, MGC12859, a homolog thereof, a mutant thereof, or a derivative thereof, or the like, unless it is defined by a SEQ ID NO. Specific examples include the HOXA10 gene (GenBank Accession No. BC013971) as shown in SEQ ID NO: 26 and homologs thereof from other organism species. The HOXA10 gene can be obtained by the method disclosed in Lowney P., et al., 1991, Nucleic Acid Res., vol. 19, pp. 3443-3449.

The term "PPP1R1A gene" or "PPP1R1A" as used herein includes the protein phosphatase 1, regulatory (inhibitor) subunit 1A gene (or DNA) as shown in a given nucleotide sequence (i.e., SEQ ID NO: 27), a gene (or DNA) encoding a homolog thereof, a mutant thereof, or a derivative thereof, or the like, unless it is defined by a SEQ ID NO. Specific examples include the PPP1R1A gene (GenBank Accession No. NM_006741) as shown in SEQ ID NO: 27, the protein phosphatase inhibitor 1, IPP-1, I-1, and homologs thereof from other organism species. The PPP1R1A gene can be obtained by the method disclosed in Endo S., et al., 1996, Biochemistry, vol. 35, pp. 5220-5228.

The term "MYO9B gene" or "MYO9B" as used herein includes the myosine IXB gene (or DNA) as shown in a given nucleotide sequence (i.e., SEQ ID NO: 28), a gene (or DNA) encoding MYR5, CELIAC4, a homolog thereof, a mutant thereof, or a derivative thereof, or the like, unless it is defined by a SEQ ID NO. Specific examples include the MYO9B gene (GenBank Accession No. NM_004145) as shown in SEQ ID NO: 28 and homologs thereof from other organism species. The MYO9B gene can be obtained by the method disclosed in Wirth J. A., et al., 1996, J. Cell. Sci., vol. 109, pp. 653-661.

The term "SLCO4C1 gene" or "SLCO4C1" as used herein includes the solute carrier organic anion transporter family, member 4C1 gene (or DNA) as shown in a given nucleotide sequence (i.e., SEQ ID NO: 29), a gene (or DNA) encoding a homolog thereof, a mutant thereof, or a derivative thereof, or the like, unless it is defined by a SEQ ID NO. Specific examples include the SLCO4C1 gene (GenBank Accession No. NM_180991) as shown in SEQ ID NO: 29 and homologs thereof from other organism species. The SLCO4C1 gene can be obtained by the method disclosed in Mikkaichi T., et al., 2004, Proc. Natl. Acad. Sci. U.S.A., vol. 101, pp. 3569-3574.

The term "SERPINB13 gene" or "SERPINB13" as used herein includes the HURPIN gene (or DNA) as shown in a given nucleotide sequence (i.e., SEQ ID NO: 30), a gene (or DNA) encoding HACAT UV-REPRESSIBLE SERPIN, PROTEASE INHIBITOR 13, HEADPIN, SERPIN B13, a homolog thereof, a mutant thereof, or a derivative thereof, or the like, unless it is defined by a SEQ ID NO. Specific examples include the SERPINB13 gene (GenBank Accession No. NM_012397) as shown in SEQ ID NO: 30 and homologs thereof from other organism species. The SERPINB13 gene can be obtained by the method disclosed in Spring P., et al., 1999, Biochem. Biophys. Res. Commun., vol. 264, pp. 299-304.

The term "SDC2 gene" or "SDC2" as used herein includes the Syndecan 2 gene (or DNA) as shown in a given nucleotide sequence (i.e., SEQ ID NO: 31), a gene (or DNA) encoding heparan sulfate proteoglycan 1, cell-associated, fibroglycan, Human heparan sulfate proteoglycan (HSPG) core protein 3' end, a homolog thereof, a mutant thereof, or a derivative thereof, or the like, unless it is defined by a SEQ ID NO. Specific examples include the SDC2 gene (GenBank Accession No. J04621) as shown in SEQ ID NO: 31 and homologs thereof from other organism species. The SDC2 gene can be obtained by the method disclosed in de Boeck H., et al., 1987, Biochem. J., vol. 247, pp. 765-771.

The term "TOR1A gene" or "TOR1A" as used herein includes the torsin family, member A gene (or DNA) as shown in a given nucleotide sequence (i.e., SEQ ID NO: 32), a gene (or DNA) encoding Dystonia 1, DYT1, DQ2, torsin A, a homolog thereof, a mutant thereof, or a derivative thereof, or the like, unless it is defined by a SEQ ID NO. Specific examples include the TOR1A gene (GenBank Accession No. NM_000113) as shown in SEQ ID NO: 32 and homologs thereof from other organism species. The TOR1A gene can be obtained by the method disclosed in Ozelius L. J., et al., 1997, Nat. Genet., vol. 17, pp. 40-48.

The term "RPL18A gene" or "RPL18A" as used herein includes the ribosomal protein L18a gene (or DNA) as shown in a given nucleotide sequence (i.e., SEQ ID NO: 33), a gene (or DNA) encoding a homolog thereof, a mutant thereof, or a derivative thereof, or the like, unless it is defined by a SEQ ID NO. Specific examples include the RPL18A gene (GenBank Accession No. NM_000980) as shown in SEQ ID NO: 33 and homologs thereof from other organism species. The RPL18A gene can be obtained by the method disclosed in Adams M. D., et al., 1992, Nature, vol. 355, pp. 632-634.

The term "GAS7 gene" or "GAS7" as used herein includes the Growth-arrest-specific protein 7 gene (or DNA) as shown in a given nucleotide sequence (i.e., SEQ ID NO: 34), a gene (or DNA) encoding GAS-7, MGC1348, a homolog thereof, a mutant thereof, or a derivative thereof, or the like, unless it is defined by a SEQ ID NO. Specific examples include the GAS7 gene (GenBank Accession No. NM_201432) as shown in SEQ ID NO: 34 and homologs thereof from other organism species. The GAS7 gene can be obtained by the method disclosed in Ju Y. T., et al., 1998, Proc. Natl. Acad. Sci. U.S.A., vol. 95, pp. 11423-11428.

The term "WISP1 gene" or "WISP1" as used herein includes the WNT1 inducible signaling pathway protein 1 gene (or DNA) as shown in a given nucleotide sequence (i.e., SEQ ID NO: 35), a gene (or DNA) encoding CCN4, WISP1c, WISP1i, WISP1tc, a homolog thereof, a mutant thereof, or a derivative thereof, or the like, unless it is defined by a SEQ ID NO. Specific examples include the WISP1 gene (GenBank Accession No. NM_003882) as shown in SEQ ID NO: 35 and homologs thereof from other organism species. The WISP1 gene can be obtained by the method disclosed in Pennica D., et al., 1998, Proc. Natl. Acad. Sci. U.S.A., vol. 95, pp. 14717-14722.

The term "CACNG4 gene" or "CACNG4" as used herein includes the voltage-dependent calcium channel gamma-4 subunit gene (or DNA) as shown in a given nucleotide sequence (i.e., SEQ ID NO: 36), a gene (or DNA) encoding the neuronal voltage-gated calcium channel gamma-4 subunit, MGC11138, MGC24983, a homolog thereof, a mutant thereof, or a derivative thereof, or the like, unless it is defined by a SEQ ID NO. Specific examples include the CACNG4 gene (GenBank Accession No. NM_014405) as shown in SEQ ID NO: 36 and homologs thereof from other organism species. The CACNG4 gene can be obtained by the method disclosed in Burgess D. L., et al., 1999, Genome Res., vol. 9, pp. 1204-1213.

The term "S100P gene" or "S100P" as used herein includes the S-100P protein gene (or DNA) as shown in a given nucleotide sequence (i.e., SEQ ID NO: 37), a gene (or DNA) encoding S100 calcium binding protein P, MIG9, a homolog thereof, a mutant thereof, or a derivative thereof, or the like, unless it is defined by a SEQ ID NO. Specific examples include the S100P gene (GenBank Accession No. NM_005980) as shown in SEQ ID NO: 37 and homologs thereof from other organism species. The S100P gene can be obtained by the method disclosed in Becker T., et al., 1992, Eur. J. Biochem., vol. 207, pp. 541-547.

The term "UCHL5 gene" or "UCHL5" as used herein includes the ubiquitin carboxyl-terminal hydrolase L5 gene (or DNA) as shown in a given nucleotide sequence (i.e., SEQ ID NO: 38), a gene (or DNA) encoding UCH37, CGI-70, a homolog thereof, a mutant thereof, or a derivative thereof, or the like, unless it is defined by a SEQ ID NO. Specific examples include the UCHL5 gene (GenBank Accession No. NM_015984) as shown in SEQ ID NO: 38 and homologs thereof from other organism species. The UCHL5 gene can be obtained by the method disclosed in Wicks S. J., et al., 2005, Oncogene, vol. 24, pp. 8080-8084.

The term "APQ3 gene" or "APQ3" as used herein includes the Aquaporin 3 gene (or DNA) as shown in a given nucleotide sequence (i.e., SEQ ID NO: 39), a gene (or DNA) encoding a homolog of APQ3, a mutant thereof, or a derivative thereof, or the like, unless it is defined by a SEQ ID NO. Specific examples include the APQ3 gene (GenBank Accession No. NM_004925) as shown in SEQ ID NO: 39 and homologs thereof from other organism species. The APQ3 gene can be obtained by the method disclosed in Kuriyama H., et al., 1997, Biochem. Biophys. Res. Commun., vol. 241, pp. 53-58.

The term "NSUN5 gene" or "NSUN5" as used herein includes the NOL1/NOP2/Sun domain family, member 5 gene (or DNA) as shown in a given nucleotide sequence (i.e., SEQ ID NO: 40), a gene (or DNA) encoding p120, NOL1R, NOL1, MGC986, NSUN5A, WBSCR20, FLJ10267, WBSCR20A, p120 (NOL1), a homolog thereof, a mutant thereof, or a derivative thereof, or the like, unless it is defined by a SEQ ID NO. Specific examples include the NSUN5 gene (GenBank Accession No. NM_018044) as shown in SEQ ID NO: 40 and homologs thereof from other organism species. The NSUN5 gene can be obtained by the method disclosed in Doll A., et al., 2001, Cytogenet. Cell Genet., vol. 95, pp. 20-27.

The term "B4GALT2 gene" or "B4GALT2" as used herein includes the UDP-Gal: betaGlcNAc beta 1,4-galactosyltransferase, polypeptide 2 gene (or DNA) as shown in a given nucleotide sequence (i.e., SEQ ID NO: 41), a gene (or DNA) encoding a homolog of B4GALT2, a mutant thereof, or a derivative thereof, or the like, unless it is defined by a SEQ ID NO. Specific examples include the B4GALT2 gene (GenBank Accession No. BC096821) as shown in SEQ ID NO: 41 and homologs thereof from other organism species. The B4GALT2 gene can be obtained by the method disclosed in Lo N. W., et al., 1998, Glycobiology, vol. 8, pp. 517-526.

The term "CD48 gene" or "CD48" as used herein includes the CD48 molecule gene (or DNA) as shown in a given nucleotide sequence (i.e., SEQ ID NO: 42), a gene (or DNA) encoding BCM1, BLAST, hCD48, mCD48, BLAST1, SLAMF2, MEM-102, a homolog thereof, a mutant thereof, or a derivative thereof, or the like, unless it is defined by a SEQ ID NO. Specific examples include the CD48 gene (GenBank Accession No. NM_001778) as shown in SEQ ID NO: 42 and homologs thereof from other organism species. The CD48 gene can be obtained by the method disclosed in Wong Y. W., et al., 1990, J. Exp. Med., vol. 171, pp. 2115-2130.

The term "DAB2 gene" or "DAB2" as used herein includes the disabled homolog 2, mitogen-responsive phosphoprotein gene (or DNA) as shown in a given nucleotide sequence (i.e., SEQ ID NO: 43), a gene (or DNA) encoding DOC2, DOC-2, FLJ26626, a homolog thereof, a mutant thereof, or a derivative thereof, or the like, unless it is defined by a SEQ ID NO. Specific examples include the DAB2 gene (GenBank Accession No. NM_001343) as shown in SEQ ID NO: 43 and homologs thereof from other organism species. The DAB2 gene can be obtained by the method disclosed in Albertsen H. M., et al., 1996, Genomics, vol. 33, pp. 207-213.

The term "EBI3 gene" or "EBI3" as used herein includes the Epstein-barn virus induced gene 3 gene (or DNA) as shown in a given nucleotide sequence (i.e., SEQ ID NO: 44), a gene (or DNA) encoding a homolog of EBI3, a mutant thereof, or a derivative thereof, or the like, unless it is defined by a SEQ ID NO. Specific examples include the EBI3 gene (GenBank Accession No. NM_005755) as shown in SEQ ID NO: 44 and homologs thereof from other organism species. The EBI3 gene can be obtained by the method disclosed in Devergne O., et al., 1996, J. Virol., vol. 70, pp. 1143-1153.

The term "MAP3K12 gene" or "MAP3K12" as used herein includes the mitogen-activated protein kinase kinase kinase 12 gene (or DNA) as shown in a given nucleotide sequence (i.e., SEQ ID NO: 45), a gene (or DNA) encoding DLK, MUK, ZPK, ZPKP1, a homolog thereof, a mutant thereof, or a derivative thereof, or the like, unless it is defined by a SEQ ID NO. Specific examples include the MAP3K12 gene (GenBank Accession No. NM_006301) as shown in SEQ ID NO: 45 and homologs thereof from other organism species. The MAP3K12 gene can be obtained by the method disclosed in Ready U. R. and Pleasure D., 1994, Biochem. Biophys. Res. Commun., vol. 202, pp. 613-620.

The term "SPEN gene" or "SPEN" as used herein includes the spen homolog, transcriptional regulator gene (or DNA) as shown in a given nucleotide sequence (i.e., SEQ ID NO: 46), a gene (or DNA) encoding MINT, SHARP, KIAA0929, RP1-134O19.1, a homolog thereof, a mutant thereof, or a derivative thereof, or the like, unless it is defined by a SEQ ID NO. Specific examples include the SPEN gene (GenBank Accession No. NM_015001) as shown in SEQ ID NO: 46 and homologs thereof from other organism species. The SPEN gene can be obtained by the method disclosed in Shi T., et al., 2001, Genes Dev., vol. 15, pp. 1140-1151.

The term "ARHGEF3 gene" or "ARHGEF3" as used herein includes the Rho guanine nucleotide exchange factor (GEF) 3 gene (or DNA) as shown in a given nucleotide sequence (i.e., SEQ ID NO: 47), a gene (or DNA) encoding GEF, STA3, XPLN, MGC118905, DKFZP434F2429, a homolog thereof, a mutant thereof, or a derivative thereof, or the like, unless it is defined by a SEQ ID NO. Specific examples include the ARHGEF3 gene (GenBank Accession No. NM_019555) as shown in SEQ ID NO: 47 and homologs thereof from other organism species. The ARHGEF3 gene can be obtained by the method disclosed in Thiesen S., et al., 2000, Biochem. Biophys. Res. Commun., vol. 273, pp. 364-369.

The term "COL3A1 gene" or "COL3A1" as used herein includes the 3' region for pro-alpha (III) collagen gene (or DNA) as shown in a given nucleotide sequence (i.e., SEQ ID NO: 48), a gene (or DNA) encoding a homolog of COL3A1, a mutant thereof, or a derivative thereof, or the like, unless it is defined by a SEQ ID NO. Specific examples include the COL3A1 gene (GenBank Accession No. X06700) as shown in SEQ ID NO: 48 and homologs thereof from other organism species. The COL3A1 gene can be obtained by the method disclosed in Loidl H. R., et al., 1984, Nucleic Acids Res., vol. 16, pp. 9383-9394.

The term "CSTB gene" or "CSTB" as used herein includes the Cystatin-B gene (or DNA) as shown in a given nucleotide sequence (i.e., SEQ ID NO: 49), a gene (or DNA) encoding Stefin-B, Liver thiol proteinase inhibitor, CPI-B, a homolog thereof, a mutant thereof, or a derivative thereof, or the like, unless it is defined by a SEQ ID NO. Specific examples include the CSTB gene (GenBank Accession No. NM_000100) as shown in SEQ ID NO: 49 and homologs thereof from other organism species. The CSTB gene can be obtained by the method disclosed in Jerala, R., et al., 1988, FEBS Lett., vol. 239, pp. 41-44.

The term "SPRR3 gene" or "SPRR3" as used herein includes the Small proline-rich protein 3 gene (or DNA) as shown in a given nucleotide sequence (i.e., SEQ ID NO: 50), a gene (or DNA) encoding Cornifine, Esophagin, a homolog thereof, a mutant thereof, or a derivative thereof, or the like, unless it is defined by a SEQ ID NO. Specific examples include the SPRR3 gene (GenBank Accession No. NM_005416) as shown in SEQ ID NO: 50 and homologs thereof from other organism species. The SPRR3 gene can be obtained by the method disclosed in Abraham J. M., et al., 1996, Cell Growth Differ., vol. 7, pp. 855-860.

The term "SLIT2 gene" or "SLIT2" as used herein includes the Slit homolog 2 protein gene (or DNA) as shown in a given nucleotide sequence (i.e., SEQ ID NO: 51), a gene (or DNA) encoding Slit-2, a homolog thereof, a mutant thereof, or a derivative thereof, or the like, unless it is defined by a SEQ ID NO. Specific examples include the SLIT2 gene (GenBank Accession No. NM_004787) as shown in SEQ ID NO: 51 and homologs thereof from other organism species. The SLIT2 gene can be obtained by the method disclosed in Holmes G. P., et al., 1998, Mech. Dev., vol. 79, pp. 57-72.

The term "CAMK2B gene" or "CAMK2B" as used herein includes the Calcium/calmodulin-dependent protein kinase type II beta chain gene (or DNA) as shown in a given nucleotide sequence (i.e., SEQ ID NO: 52), a gene (or DNA) encoding CaM-kinase II beta chain, CaM kinase II subunit beta, CaMK-II subunit beta, a homolog thereof, a mutant thereof, or a derivative thereof, or the like, unless it is defined by a SEQ ID NO. Specific examples include the CAMK2B gene (GenBank Accession No. NM_001220) as shown in SEQ ID NO: 52 and homologs thereof from other organism species. The CAMK2B gene can be obtained by the method disclosed in Tombes R. M., et al., 1997, Biochem. Biophys. Acta., vol. 1355, pp. 281-292.

The term "SLC2A14 gene" or "SLC2A14" as used herein includes the Solute carrier family 2 gene (or DNA) as shown in a given nucleotide sequence (i.e., SEQ ID NO: 53), a gene (or DNA) encoding facilitated glucose transporter member 14, Glucose transporter type 14, GLUT14, a homolog thereof, a mutant thereof, or a derivative thereof, or the like, unless it is defined by a SEQ ID NO. Specific examples include the SLC2A14 gene (GenBank Accession No. NM_153449) as shown in SEQ ID NO: 53 and homologs thereof from other organism species. The SLC2A14 gene can be obtained by the method disclosed in Wu X. et al., 2002, Genomics, vol. 80, pp. 553-557.

The term "SATB2 gene" or "SATB2" as used herein includes the DNA-binding protein SATB2 gene (or DNA) as shown in a given nucleotide sequence (i.e., SEQ ID NO: 54), a gene (or DNA) encoding Special AT-rich sequence-binding protein 2, FLJ21474, KIAA1034, a homolog thereof, a mutant thereof, or a derivative thereof, or the like, unless it is defined by a SEQ ID NO. Specific examples include the SATB2 gene (GenBank Accession No. NM_015265) as shown in SEQ ID NO: 54 and homologs thereof from other organism species. The SATB2 gene can be obtained by the method disclosed in FitzPatrick D. R., et al., 2003, Hum. Mol. Genet., vol. 12, pp. 2491-2501.

The term "SEPT6 gene" or "SEPT6" as used herein includes the septin-6 gene (or DNA) as shown in a given nucleotide sequence (i.e., SEQ ID NO: 55), a gene (or DNA) encoding KIAA0128, MGC16619, MGC20339, SEP2, SEPT2, a homolog thereof, a mutant thereof, or a derivative thereof, or the like, unless it is defined by a SEQ ID NO. Specific examples include the SEPT6 gene (GenBank Accession No. NM_015129) as shown in SEQ ID NO: 55 and homologs thereof from other organism species. The SEPT6 gene can be obtained by the method disclosed in Sui L., et al., 2003, Biochem. Biophys. Res. Commun., vol. 304, pp. 393-398.

The term "GALNS gene" or "GALNS" as used herein includes the galactosamine (N-acetyl)-6-sulfate sulfatase gene (or DNA) as shown in a given nucleotide sequence (i.e., SEQ ID NO: 56), a gene (or DNA) encoding Morquio syndrome, mucopolysaccharidosis type IVA, a homolog thereof, a mutant thereof, or a derivative thereof, or the like, unless it is defined by a SEQ ID NO. Specific examples include the GALNS gene (GenBank Accession No. NM_000512) as shown in SEQ ID NO: 56 and homologs thereof from other organism species. The GALNS gene can be obtained by the method disclosed in Nakashima Y., et al., 1994, Genomics, vol. 20, pp. 99-104.

The term "TROAP gene" or "TROAP" as used herein includes the trophinin associated protein gene (or DNA) as shown in a given nucleotide sequence (i.e., SEQ ID NO: 57), a gene (or DNA) encoding tastin, a homolog thereof, a mutant thereof, or a derivative thereof, or the like, unless it is defined by a SEQ ID NO. Specific examples include the TROAP gene (GenBank Accession No. NM_005480) as shown in SEQ ID NO: 57 and homologs thereof from other organism species. The TROAP gene can be obtained by the method disclosed in Fukuda M. N., et al., 1995, Genes Dev., vol. 9, pp. 1199-1210.

The term "XRCC3 gene" or "XRCC3" as used herein includes the X-ray repair complementing defective repair in Chinese hamster cells 3 gene (or DNA) as shown in a given nucleotide sequence (i.e., SEQ ID NO: 58), a gene (or DNA) encoding a homolog of XRCC3, a mutant thereof, or a derivative thereof, or the like, unless it is defined by a SEQ ID NO. Specific examples include the XRCC3 gene (GenBank Accession No. NM_005432) as shown in SEQ ID NO: 58 and homologs thereof from other organism species. The XRCC3 gene can be obtained by the method disclosed in Tebbs R. S., et al., 1995, Proc. Natl. Acad. Sci. U.S.A., vol. 92, pp. 6354-6358.

The term "FGF3 gene" or "FGF3" as used herein includes the fibroblast growth factor 3 gene (or DNA) as shown in a given nucleotide sequence (i.e., SEQ ID NO: 59), a gene (or DNA) encoding the murine mammary tumor virus integration site (v-int-2) oncogene homolog, INT-2, HBGF-3, a homolog thereof, a mutant thereof, or a derivative thereof, or the like, unless it is defined by a SEQ ID NO. Specific examples include the FGF3 gene (GenBank Accession No. NM_005247) as shown in SEQ ID NO: 59 and homologs thereof from other organism species. The FGF3 gene can be obtained by the method disclosed in Brookes S., et al., 1989, Oncogene, vol. 4, pp. 429-436.

The term "EIF4EBP2 gene" or "EIF4EBP2" as used herein includes the eukaryotic translation initiation factor 4E binding protein 2 gene (or DNA) as shown in a given nucleotide sequence (i.e., SEQ ID NO: 60), a gene (or DNA) encoding 4EBP2, a homolog thereof, a mutant thereof, or a derivative thereof, or the like, unless it is defined by a SEQ ID NO. Specific examples include the EIF4EBP2 gene (GenBank Accession No. NM_004096) as shown in SEQ ID NO: 60 and homologs thereof from other organism species. The EIF4EBP2 gene can be obtained by the method disclosed in Pause A., et al., 1994, Nature., vol. 371, pp. 762-767. The elevated expression of the EIF4EBP2 gene in a metastatic subcell line of established esophageal cancer cell line is demonstrated in Kawamata, H. et al., 2003, Cancer Science, vol. 94, pp. 699-706.

The term "RRM1 gene" or "RRM1" as used herein includes the ribonucleotide reductase M1 polypeptide gene (or DNA) as shown in a given nucleotide sequence (i.e., SEQ ID NO: 61), a gene (or DNA) encoding R1, RR1, RIR1, a homolog thereof, a mutant thereof, or a derivative thereof, or the like, unless it is defined by a SEQ ID NO. Specific examples include the RRM1 gene (GenBank Accession No. NM_001033) as shown in SEQ ID NO: 61 and homologs thereof from other organism species. The RRM1 gene can be obtained by the method disclosed in Parker N. J., et al., 1994, Genomics, vol. 19, pp. 91-96.

The term "M6PR gene" or "M6PR" as used herein includes the mannose-6-phosphate receptor (cation dependent) gene (or DNA) as shown in a given nucleotide sequence (i.e., SEQ ID NO: 62), a gene (or DNA) encoding a homolog of M6PR, a mutant thereof, or a derivative thereof, or the like, unless it is defined by a SEQ ID NO. Specific examples include the M6PR gene (GenBank Accession No. NM_002355) as shown in SEQ ID NO: 62 and homologs thereof from other organism species. The M6PR gene can be obtained by the method disclosed in Pohlmann R., et al., 1987, Proc. Natl. Acad. Sci. U.S.A., vol. 84, pp. 5575-5579.

Advantage of the Invention

The present invention provides a composition for determining a disease useful for diagnosis and treatment of esophageal cancer and a method for determining (or detecting) esophageal cancer using the composition. Use of the composition produces a remarkable advantage that is to provide a specific, highly predictable, rapid and simple method for determining the esophageal cancer.

This description includes the contents as disclosed in the description and/or drawings of Japanese Patent Application No. 2008-133491, which is a priority document of the present application.

EMBODIMENTS FOR CARRYING OUT THE INVENTION

Figure 1:
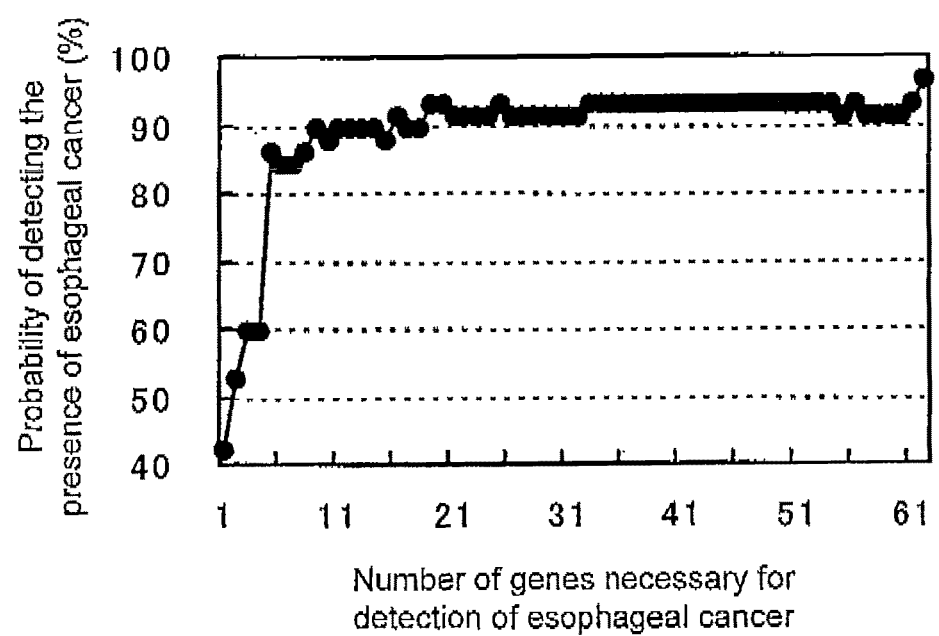
FIG. 1 shows the detection rate of the presence of esophageal cancer cells by using any combination of the polynucleotides as shown in SEQ ID NOs: 63 to 124 which correspond to the genes described in Table 1. The vertical axis shows the probability of detecting the presence of esophageal cancer tissues in specimens; and the horizontal axis shows the total number of genes required for detecting esophageal cancer and increased in order, in the SEQ ID NOs. of the Table 1.

Hereafter, the present invention is described in more detail.
1. Target Nucleic Acids of Esophageal Cancer Examples of target nucleic acids as markers for esophageal cancer used for determining the presence and/or absence of esophageal cancer or esophageal cancer cells with the use of the composition and the kit for diagnosis of esophageal cancer as defined above include human genes each comprising the nucleotide sequence as shown in any of SEQ ID NOs: 1 to 62 (i.e., EYA2, SERF1A, IGHG1, ITSN2, RAB11FIP5, HSPA1A, NMU, E2F3, ESR2, CFDP1, HSPC190, COL1A2, GCS1, PARL, CELSR2, NDRG1, SLC25A44, TUSC2, SLC4A1, MS4A7, TMSB4X, PRC1, VCP, RBM9, GPR126, HOXA10, PPP1R1A, MYO9B, SLCO4C1, SERPINB13, SDC2, TOR1A, RPL18A, GAS7, WISP1, CACNG4, S100P, UCHL5, AQP3, NSUN5, B4GALT2, CD48, DAB2, EBI3, MAP3K12, SPEN, ARHGEF3, COL3A1, CSTB, SPRR3, SLIT2, CAMK2B, SLC2A14, SATB2, SEPT6, GALNS, TROAP, XRCC3, FGF3, EIF4EBP2, RRM1, and M6PR, respectively), homologs thereof, transcription products or cDNAs thereof, and mutants or derivatives thereof. The terms "gene," "homolog," "transcription product," "cDNA," "mutant," and "derivative" are as defined above. The target nucleic acids are preferably human genes, each of which comprises the nucleotide sequence as shown in any of SEQ ID NOs: 1 to 62, and transcription products or cDNAs thereof, more preferably transcription products or cDNAs thereof.

According to the present invention, the expression levels of the genes, which are targets of esophageal cancer, are increased or decreased in subjects with esophageal cancer, when compared with healthy subjects (see Table 1 in Examples below).

The 1st target nucleic acid is the EYA2 gene, a homolog thereof, a transcription product or cDNA thereof, or a mutant or derivative thereof. Up to the present, there has been no report that the increased expression of the EYA2 gene or a transcription product thereof could function as an esophageal cancer marker.

The 2nd target nucleic acid is the SERF1A gene, a homolog thereof, a transcription product or cDNA thereof, or a mutant or derivative thereof. Up to the present, there has been no report that the increased expression of the SERF1A gene or a transcription product thereof could function as an esophageal cancer marker.

The 3rd target nucleic acid is the IGHG1 gene, a homolog thereof, a transcription product or cDNA thereof, or a mutant or derivative thereof. Up to the present, there has been no report that the increased expression of the IGHG1 gene or a transcription product thereof could function as an esophageal cancer marker.

The 4th target nucleic acid is the ITSN2 gene, a homolog thereof, a transcription product or cDNA thereof, or a mutant or derivative thereof. Up to the present, there has been no report that the increased expression of the ITSN2 gene or a transcription product thereof could function as an esophageal cancer marker.

The 5th target nucleic acid is the RAB11FIP5 gene, a homolog thereof, a transcription product or cDNA thereof, or a mutant or derivative thereof. Up to the present, there has been no report that the increased expression of the RAB11FIP5 gene and a transcription product thereof could function as an esophageal cancer marker.

The 6th target nucleic acid is the HSPA1A gene, a homolog thereof, a transcription product or cDNA thereof, or a mutant or derivative thereof. Up to the present, there has been no report that the increased expression of the HSPA1A gene and a transcription product thereof could function as an esophageal cancer marker.

The 7th target nucleic acid is the NMU gene, a homolog thereof, a transcription product or cDNA thereof, or a mutant or derivative thereof. Up to the present, there has been no report that the increased expression of the NMU gene and a transcription product thereof could function as an esophageal cancer marker.

The 8th target nucleic acid is the E2F3 gene, a homolog thereof, a transcription product or cDNA thereof, or a mutant or derivative thereof. Up to the present, there has been no report that the increased expression of the E2F3 gene and a transcription product thereof could function as an esophageal cancer marker.

The 9th target nucleic acid is the ESR2 gene, a homolog thereof, a transcription product or cDNA thereof, or a mutant or derivative thereof. Up to the present, there has been no report that the increased expression of the ESR2 gene and a transcription product thereof could function as an esophageal cancer marker.

The 10th target nucleic acid is the CFDP1 gene, a homolog thereof, a transcription product or cDNA thereof, or a mutant or derivative thereof. Up to the present, there has been no report that the increased expression of the CFDP1 gene and a transcription product thereof could function as an esophageal cancer marker.

The 11th target nucleic acid is the HSPC190 gene, a homolog thereof, a transcription product or cDNA thereof, or a mutant or derivative thereof. Up to the present, there has been no report that the increased expression of the HSPC190 gene and a transcription product thereof could function as an esophageal cancer marker.

The 12th target nucleic acid is the COL1A2 gene, a homolog thereof, a transcription product or cDNA thereof, or a mutant or derivative thereof. Up to the present, there has been no report that the increased expression of the COL1A2 gene and a transcription product thereof could function as an esophageal cancer marker.

The 13th target nucleic acid is the GCS1 gene, a homolog thereof, a transcription product or cDNA thereof, or a mutant or derivative thereof. Up to the present, there has been no report that the increased expression of the GCS1 gene and a transcription product thereof could function as an esophageal cancer marker.

The 14th target nucleic acid is the PARL gene, a homolog thereof, a transcription product or cDNA thereof, or a mutant or derivative thereof. Up to the present, there has been no report that the decreased expression of the PARL gene and a transcription product thereof could function as an esophageal cancer marker.

The 15th target nucleic acid is the CELSR2 gene, a homolog thereof, a transcription product or cDNA thereof, or a mutant or derivative thereof. Up to the present, there has been no report that the increased expression of the CELSR2 gene and a transcription product thereof could function as an esophageal cancer marker.

The 16th target nucleic acid is the NDRG1 gene, a homolog thereof, a transcription product or cDNA thereof, or a mutant or derivative thereof. Up to the present, there has been no report that the increased expression of the NDRG1 gene and a transcription product thereof could function as an esophageal cancer marker.

The 17th target nucleic acid is the SLC25A44 gene, a homolog thereof, a transcription product or cDNA thereof, or a mutant or derivative thereof. Up to the present, there has been no report that the increased expression of the SLC25A44 gene and a transcription product thereof could function as an esophageal cancer marker.

The 18th target nucleic acid is the TUSC2 gene, a homolog thereof, a transcription product or cDNA thereof, or a mutant or derivative thereof. Up to the present, there has been no report that the increased expression of the TUSC2 gene and a transcription product thereof could function as an esophageal cancer marker.

The 19th target nucleic acid is the SLC4A1 gene, a homolog thereof, a transcription product or cDNA thereof, or a mutant or derivative thereof. Up to the present, there has been no report that the increased expression of the SLC4A1 gene and a transcription product thereof could function as an esophageal cancer marker.

The 20th target nucleic acid is the MS4A7 gene, a homolog thereof, a transcription product or cDNA thereof, or a mutant or derivative thereof. Up to the present, there has been no report that the decreased expression of the MS4A7 gene and a transcription product thereof could function as an esophageal cancer marker.

The 21st target nucleic acid is the TMSB4X gene, a homolog thereof, a transcription product or cDNA thereof, or a mutant or derivative thereof. Up to the present, there has been no report that the increased expression of the TMSB4X gene and a transcription product thereof could function as an esophageal cancer marker.

The 22nd target nucleic acid is the PRC1 gene, a homolog thereof, a transcription product or cDNA thereof, or a mutant or derivative thereof. Up to the present, there has been no report that the decreased expression of the PRC1 gene and a transcription product thereof could function as an esophageal cancer marker.

The 23rd target nucleic acid is the VCP gene, a homolog thereof, a transcription product or cDNA thereof, or a mutant or derivative thereof. Up to the present, there has been no report that the increased expression of the VCP gene and a transcription product thereof could function as an esophageal cancer marker.

The 24th target nucleic acid is the RBM9 gene, a homolog thereof, a transcription product or cDNA thereof, or a mutant or derivative thereof. Up to the present, there has been no report that the increased expression of the RBM9 gene and a transcription product thereof could function as an esophageal cancer marker.

The 25th target nucleic acid is the GPR126 gene, a homolog thereof, a transcription product or cDNA thereof, or a mutant or derivative thereof. Up to the present, there has been no report that the increased expression of the GPR126 gene and a transcription product thereof could function as an esophageal cancer marker.

The 26th target nucleic acid is the HOXA10 gene, a homolog thereof, a transcription product or cDNA thereof, or a mutant or derivative thereof. Up to the present, there has been no report that the increased expression of the HOXA10 gene and a transcription product thereof could function as an esophageal cancer marker.

The 27th target nucleic acid is the PPP1R1A gene, a homolog thereof, a transcription product or cDNA thereof, or a mutant or derivative thereof. Up to the present, there has been no report that the increased expression of the PPP1R1A gene and a transcription product thereof could function as an esophageal cancer marker.

The 28th target nucleic acid is the MYO9B gene, a homolog thereof, a transcription product or cDNA thereof, or a mutant or derivative thereof. Up to the present, there has been no report that the increased expression of the MYO9B gene and a transcription product thereof could function as an esophageal cancer marker.

The 29th target nucleic acid is the SLCO4C1 gene, a homolog thereof, a transcription product or cDNA thereof, or a mutant or derivative thereof. There has been no report that the increased expression of the SLCO4C1 gene and a transcription product thereof could function as an esophageal cancer marker.

The 30th target nucleic acid is the SERPINB13 gene, a homolog thereof, a transcription product or cDNA thereof, or a mutant or derivative thereof. There has been no report that the increased expression of the SERPINB13 gene and a transcription product thereof could function as an esophageal cancer marker.

The 31st target nucleic acid is the SDC2 gene, a homolog thereof, a transcription product or cDNA thereof, or a mutant or derivative thereof. There has been no report that the decreased expression of the SDC2 gene and a transcription product thereof could function as an esophageal cancer marker.

The 32nd target nucleic acid is the TOR1A gene, a homolog thereof, a transcription product or cDNA thereof, or a mutant or derivative thereof. There has been no report that the increased expression of the TOR1A gene and a transcription product thereof could function as an esophageal cancer marker.

The 33rd target nucleic acid is the RPL18A gene, a homolog thereof, a transcription product or cDNA thereof, or a mutant or derivative thereof. There has been no report that the increased expression of the RPL18A gene and a transcription product thereof could function as an esophageal cancer marker.

The 34th target nucleic acid is the GAS7 gene, a homolog thereof, a transcription product or cDNA thereof, or a mutant or derivative thereof. There has been no report that the increased expression of the GAS7 gene and a transcription product thereof could function as an esophageal cancer marker.

The 35th target nucleic acid is the WISP1 gene, a homolog thereof, a transcription product or cDNA thereof, or a mutant or derivative thereof. There has been no report that the decreased expression of the WISP1 gene and a transcription product thereof could function as an esophageal cancer marker.

The 36th target nucleic acid is the CACNG4 gene, a homolog thereof, a transcription product or cDNA thereof, or a mutant or derivative thereof. There has been no report that the increased expression of the CACNG4 gene and a transcription product thereof could function as an esophageal cancer marker.

The 37th target nucleic acid is the S100P gene, a homolog thereof, a transcription product or cDNA thereof, or a mutant or derivative thereof. There has been no report that the decreased expression of the S100P gene and a transcription product thereof could function as an esophageal cancer marker.

The 38th target nucleic acid is the UCHL5 gene, a homolog thereof, a transcription product or cDNA thereof, or a mutant or derivative thereof. There has been no report that the decreased expression of the UCHL5 gene and a transcription product thereof could function as an esophageal cancer marker.

The 39th target nucleic acid is the AQP3 gene, a homolog thereof, a transcription product or cDNA thereof, or a mutant or derivative thereof. Up to the present, it has been found that the expression of the AQP3 gene and a transcription product thereof could function as an esophageal cancer marker (WO 06118308).

The 40th target nucleic acid is the NSUN5 gene, a homolog thereof, a transcription product or cDNA thereof, or a mutant or derivative thereof. Up to the present, it has been found that the expression of the NSUN5 gene and a transcription product thereof could function as an esophageal cancer marker (WO 06118308).

The 41st target nucleic acid is the B4GALT2 gene, a homolog thereof, a transcription product or cDNA thereof, or a mutant or derivative thereof. Up to the present, it has been found that the expression of the B4GALT2 gene and a transcription product thereof could function as an esophageal cancer marker (WO 06118308).

The 42nd target nucleic acid is the CD48 gene, a homolog thereof, a transcription product or cDNA thereof, or a mutant or derivative thereof. Up to the present, it has been found that the expression of the CD48 gene and a transcription product thereof could function as an esophageal cancer marker (WO 06118308).

The 43rd target nucleic acid is the DAB2 gene, a homolog thereof, a transcription product or cDNA thereof, or a mutant or derivative thereof. Up to the present, it has been found that the expression of the DAB2 gene and a transcription product thereof could function as an esophageal cancer marker (WO 06118308).

The 44th target nucleic acid is the EBI3 gene, a homolog thereof, a transcription product or cDNA thereof, or a mutant or derivative thereof. Up to the present, it has been found that the expression of the EBI3 gene and a transcription product thereof could function as an esophageal cancer marker (WO 06118308).

The 45th target nucleic acid is the MAP3K12 gene, a homolog thereof, a transcription product or cDNA thereof, or a mutant or derivative thereof. Up to the present, it has been found that the expression of the MAP3K12 gene and a transcription product thereof could function as an esophageal cancer marker (WO 06118308).

The 46th target nucleic acid is the SPEN gene, a homolog thereof, a transcription product or cDNA thereof, or a mutant or derivative thereof. It has been found that the expression of the SPEN gene and a transcription product thereof could function as an esophageal cancer marker (WO 06118308).

The 47th target nucleic acid is the ARHGEF3 gene, a homolog thereof, a transcription product or cDNA thereof, or a mutant or derivative thereof. It has been found that the expression of the ARHGEF3 gene and a transcription product thereof could function as an esophageal cancer marker (WO 06118308).

The 48th target nucleic acid is the COL3A1 gene, a homolog thereof, a transcription product or cDNA thereof, or a mutant or derivative thereof. It has been found that the expression of the COL3A1 gene and a transcription product thereof could function as an esophageal cancer marker (Su, H., et al., 2003, Cancer Research, vol. 63, pp. 3872-3876).

The 49th target nucleic acid is the CSTB gene, a homolog thereof, a transcription product or cDNA thereof, or a mutant or derivative thereof. Up to the present, it has been found that the expression of the CSTB gene and a transcription product thereof could function as an esophageal cancer marker (WO 03042661; Shiraishi, T., et al., 1998, International Journal of Cancer, vol. 79, pp. 175-178).

The 50th target nucleic acid is the SPRR3 gene, a homolog thereof, a transcription product or cDNA thereof, or a mutant or derivative thereof. It has been found that the SPRR3 gene could function as an esophageal cancer marker (WO 06118308; WO 2003/042661; Chem, B. S., et al., 2000, Carcinogenesis, vol. 21, p2147-2150; Abraham, J. M., et al., 1996, Cell Growth & Differentiation, vol. 7, p855-860).

The 51st target nucleic acid is the SLIT2 gene, a homolog thereof, a transcription product or cDNA thereof, or a mutant or derivative thereof. Up to the present, it has been found that the SLIT2 gene could function as an esophageal cancer marker (WO 06118308).

The 52nd target nucleic acid is the CAMK2B gene, a homolog thereof, a transcription product or cDNA thereof, or a mutant or derivative thereof. It has been found that the CAMK2B gene could function as an esophageal cancer marker (WO 06118308).

The 53rd target nucleic acid is the SLC2A14 gene, a homolog thereof, a transcription product or cDNA thereof, or a mutant or derivative thereof. It has been found that the SLC2A14 gene could function as an esophageal cancer marker (WO 06118308).

The 54th target nucleic acid is the SATB2 gene, a homolog thereof, a transcription product or cDNA thereof, or a mutant or derivative thereof. It has been found that the SATB2 gene could function as an esophageal cancer marker (WO 06118308).

The 55th target nucleic acid is the SEPT6 gene, a homolog thereof, a transcription product or cDNA thereof, or a mutant or derivative thereof. Up to the present, there has been no report that the decreased expression of the SEPT6 gene and a transcription product thereof could function as an esophageal cancer marker.

The 56th target nucleic acid is the GALNS gene, a homolog thereof, a transcription product or cDNA thereof, or a mutant or derivative thereof. It has been found that the GALNS gene could function as an esophageal cancer marker (WO 06118308).

The 57th target nucleic acid is the TROAP gene, a homolog thereof, a transcription product or cDNA thereof, or a mutant or derivative thereof. It has been found that the TROAP gene could function as an esophageal cancer marker (WO 06118308).

The 58th target nucleic acid is the XRCC3 gene, a homolog thereof, a transcription product or cDNA thereof, or a mutant or derivative thereof. It has been found that the XRCC3 gene could function as an esophageal cancer marker (WO 06118308).

The 59th target nucleic acid is the FGF3 gene, a homolog thereof, a transcription product or cDNA thereof, or a mutant or derivative thereof. It has been found that the FGF3 gene could function as an esophageal cancer marker (WO 06118308).

The 60th target nucleic acid is the EIF4EBP2 gene, a homolog thereof, a transcription product or cDNA thereof, or a mutant or derivative thereof. It has been found that the EIF4EBP2 gene could function as an esophageal cancer marker (WO 06118308).

The 61st target nucleic acid is the RRM1 gene, a homolog thereof, a transcription product or cDNA thereof, or a mutant or derivative thereof. It has been found that the RRM1 gene could function as an epithelial malignant tumor marker (WO 06119464A1).

The 62nd target nucleic acid is the M6PR gene, a homolog thereof, a transcription product or cDNA thereof, or a mutant or derivative thereof. It has been found that the M6PR gene could function as an esophageal cancer marker (WO 06118308).

2. Target Polypeptide of Esophageal Cancer

Examples of target polypeptides as the esophageal cancer markers for determining the presence and/or absence of esophageal cancer or esophageal cancer cells using the composition and the kit for diagnosis of esophageal cancer of the present invention are polypeptides encoded by human genes each comprising the nucleotide sequence as shown in any of SEQ ID NOs: 1 to 62 (i.e., EYA2, SERF1A, IGHG1, ITSN2, RAB11FIP5, HSPA1A, NMU, E2F3, ESR2, CFDP1, HSPC190, COL1A2, GCS1, PARL, CELSR2, NDRG1, SLC25A44, TUSC2, SLC4A1, MS4A7, TMSB4X, PRC1, VCP, RBM9, GPR126, HOXA10, PPP1R1A, MYO9B, SLCO4C1, SERPINB13, SDC2, TOR1A, RPL18A, GAS7, WISP1, CACNG4, S100P, UCHL5, AQP3, NSUN5, B4GALT2, CD48, DAB2, EBI3, MAP3K12, SPEN, ARHGEF3, COL3A1, CSTB, SPRR3, SLIT2, CAMK2B, SLC2A14, SATB2, SEPT6, GALNS, TROAP, XRCC3, FGF3, EIF4EBP2, RRM1, and M6PR, respectively), such as human polypeptides each comprising the amino acid sequence as shown in any of SEQ ID NOs: 125 to 186, homologs thereof, or mutants or derivatives thereof. The terms "polypeptide," "homolog," "mutant," and "derivative" are as defined above. The target polypeptides are preferably human polypeptides each comprising the amino acid sequence as shown in any of SEQ ID NOs: 125 to 186.

The present invention is characterized in that the expression levels of the polypeptides, which are targets of esophageal cancer, decrease in the esophageal cancer tissue, when compared with the non-cancerous tissue, as in the case of the expression levels of the corresponding genes and of the transcription products thereof, or the blood levels of the polypeptides are increased or decreased in a subject with esophageal cancer, when compared with a healthy subject.

3. Composition for Diagnosis of Esophageal Cancer 3.1 Nucleic Acid

The nucleic acid composition that can be used for determining or diagnosing esophageal cancer in the present invention enables qualitative and/or quantitative measurement of the presence, the expression level, or the amount of human-derived EYA2, SERF1A, IGHG1, ITSN2, RAB11FIP5, HSPA1A, NMU, E2F3, ESR2, CFDP1, HSPC190, COL1A2, GCS1, PARL, CELSR2, NDRG1, SLC25A44, TUSC2, SLC4A1, MS4A7, TMSB4X, PRC1, VCP, RBM9, GPR126, HOXA10, PPP1R1A, MYO9B, SLCO4C1, SERPINB13, SDC2, TOR1A, RPL18A, GAS7, WISP1, CACNG4, S100P, UCHL5, AQP3, NSUN5, B4GALT2, CD48, DAB2, EBI3, MAP3K12, SPEN, ARHGEF3, COL3A1, CSTB, SPRR3, SLIT2, CAMK2B, SLC2A14, SATB2, SEPT6, GALNS, TROAP, XRCC3, FGF3, EIF4EBP2, RRM1, and M6PR genes, homologs thereof, transcription products or cDNAs thereof, or mutants or derivatives thereof as target nucleic acids of esophageal cancer.

The expression levels of the target nucleic acids are increased or decreased (or increased/descreased) in a subject with esophageal cancer compared with a healthy subject. Thus, the composition of the present invention can be effectively used for measuring and comparing the expression levels of the target nucleic acids both in esophageal cancer tissue and in normal esophageal tissue.

The composition that can be used in the present invention comprises a combination of one or more (preferably three or more, and more preferably five or more) polynucleotides selected from the group consisting of: polynucleotides each comprising a nucleotide sequence as shown in any of SEQ ID NOs: 1 to 62 from the body tissue of a esophageal cancer patient and polynucleotides complementary thereto; polynucleotides each hybridizing under stringent conditions to DNA consisting of a nucleotide sequence complementary to the nucleotide sequence and polynucleotides complementary thereto; and polynucleotides each comprising at least 15, preferably at least 20, and more preferably at least 25 continuous nucleotides in any of the nucleotide sequences of the polynucleotides above.

Specifically, the composition of the present invention may comprise one or more (preferably three or more, and more preferably five or more) polynucleotides or fragments thereof as set forth below:

(1) polynucleotides each consisting of the nucleotide sequence as shown in any of SEQ ID NOs: 1 to 62, mutants thereof, or fragments thereof comprising at least 15 continuous nucleotides;

(2) polynucleotides each comprising a nucleotide sequence as shown in any of SEQ ID NOs: 1 to 62;

(3) polynucleotides each consisting of the nucleotide sequence as shown in any of SEQ ID NOs: 1 to 62, mutants thereof, or fragments thereof comprising at least 15 continuous nucleotides;

(4) polynucleotides each comprising a nucleotide sequence as shown in any of SEQ ID NOs: 1 to 38;

(5) polynucleotides each consisting of a nucleotide sequence complementary to the nucleotide sequence as shown in any of SEQ ID NOs: 1 to 38, mutants thereof, or fragments thereof each comprising at least 15 continuous nucleotides;

(6) polynucleotides each comprising a nucleotide sequence complementary to the nucleotide sequence as shown in any of SEQ ID NOs: 1 to 38;

(7) polynucleotides each hybridizing under stringent conditions to DNA consisting of a nucleotide sequence complementary to the nucleotide sequence as shown in any of SEQ ID NOs: 1 to 38 or fragments thereof each comprising at least 15 continuous nucleotides;

(8) polynucleotides each hybridizing under stringent conditions to DNA consisting of the nucleotide sequence as shown in any of SEQ ID NOs: 1 to 38 or fragments thereof each comprising at least 15 continuous nucleotides;

(9) polynucleotides each consisting of the nucleotide sequence as shown in any of SEQ ID NOs: 39 to 62, mutants thereof, or fragments thereof each comprising at least 15 continuous nucleotides;

(10) polynucleotides each comprising a nucleotide sequence as shown in any of SEQ ID NOs: 39 to 62;

(11) polynucleotides each consisting of a nucleotide sequence complementary to the nucleotide sequence as shown in any of SEQ ID NOs: 39 to 62, mutants thereof, or fragments thereof each comprising at least 15 continuous nucleotides;

(12) polynucleotides each comprising a nucleotide sequence complementary to the nucleotide sequence as shown in any of SEQ ID NOs: 39 to 62;

(13) polynucleotides each hybridizing under stringent conditions to DNA consisting of a nucleotide sequence complementary to the nucleotide sequence as shown in any of SEQ ID NOs: 39 to 62 or fragments thereof each comprising at least 15 continuous nucleotides; and

(14) polynucleotides each hybridizing under stringent conditions to DNA consisting of the nucleotide sequence as shown in any of SEQ ID NOs: 39 to 62 or fragments thereof each comprising at least 15 continuous nucleotides.

Fragments of the polynucleotides as described in (1) to (14) above can include, but are not limited to, nucleotide sequences of, for example, continuous 15 to all nucleotides, 15 to 5,000 nucleotides, 15 to 4,500 nucleotides, 15 to 4,000 nucleotides, 15 to 3,500 nucleotides, 15 to 3,000 nucleotides, 15 to 2,500 nucleotides, 15 to 2,000 nucleotides, 15 to 1,500 nucleotides, 15 to 1,000 nucleotides, 15 to 900 nucleotides, 15 to 800 nucleotides, 15 to 700 nucleotides, 15 to 600 nucleotides, 15 to 500 nucleotides, 15 to 400 nucleotides, 15 to 300 nucleotides, 15 to 250 nucleotides, 15 to 200 nucleotides, 15 to 150 nucleotides, 15 to 140 nucleotides, 15 to 130 nucleotides, 15 to 120 nucleotides, 15 to 110 nucleotides, 15 to 100 nucleotides, 15 to 90 nucleotides, 15 to 80 nucleotides, 15 to 70 nucleotides, 15 to 60 nucleotides, 15 to 50 nucleotides, 15 to 40 nucleotides, 15 to 30 nucleotides, or 15 to 25 nucleotides; 25 to all nucleotides, 25 to 1,000 nucleotides, 25 to 900 nucleotides, 25 to 800 nucleotides, 25 to 700 nucleotides, 25 to 600 nucleotides, 25 to 500 nucleotides, 25 to 400 nucleotides, 25 to 300 nucleotides, 25 to 250 nucleotides, 25 to 200 nucleotides, 25 to 150 nucleotides, 25 to 140 nucleotides, 25 to 130 nucleotides, 25 to 120 nucleotides, 25 to 110 nucleotides, 25 to 100 nucleotides, 25 to 90 nucleotides, 25 to 80 nucleotides, 25 to 70 nucleotides, 25 to 60 nucleotides, 25 to 50 nucleotides, or 25 to 40 nucleotides; 50 to all nucleotides, 50 to 1,000 nucleotides, 50 to 900 nucleotides, 50 to 800 nucleotides, 50 to 700 nucleotides, 50 to 600 nucleotides, 50 to 500 nucleotides, 50 to 400 nucleotides, 50 to 300 nucleotides, 50 to 250 nucleotides, 50 to 200 nucleotides, 50 to 150 nucleotides, 50 to 140 nucleotides, 50 to 130 nucleotides, 50 to 120 nucleotides, 50 to 110 nucleotides, 50 to 100 nucleotides, 50 to 90 nucleotides, 50 to 80 nucleotides, 50 to 70 nucleotides, or 50 to 60 nucleotides; or 60 to all nucleotides, 60 to 1,000 nucleotides, 60 to 900 nucleotides, 60 to 800 nucleotides, 60 to 700 nucleotides, 60 to 600 nucleotides, 60 to 500 nucleotides, 60 to 400 nucleotides, 60 to 300 nucleotides, 60 to 250 nucleotides, 60 to 200 nucleotides, 60 to 150 nucleotides, 60 to 140 nucleotides, 60 to 130 nucleotides, 60 to 120 nucleotides, 60 to 110 nucleotides, 60 to 100 nucleotides, 60 to 90 nucleotides, 60 to 80 nucleotides, or 60 to 70 nucleotides, in the nucleotide sequence of each polynucleotide.

According to an embodiment of the invention, a fragment of a polynucleotide comprising the nucleotide sequence as shown in any of SEQ ID NOs: 1 to 62 preferably comprises a nucleotide sequence as shown in any of SEQ ID NOs: 63 to 124, respectively, a complementary sequence thereof, or a partial sequence comprising at least 15 continuous nucleotides thereof.

The composition of the present invention includes the following polynucleotides, for example:

(1) a polynucleotide comprising at least 15 continuous nucleotides in the nucleotide sequence as shown in any of SEQ ID NOs: 1 to 38 or a sequence complementary thereto;

(2) a polynucleotide comprising at least 60 continuous nucleotides in the nucleotide sequence as shown in any of SEQ ID NOs: 1 to 38 or a sequence complementary thereto;

(3) a polynucleotide comprising at least 15 continuous nucleotides in the nucleotide sequence as shown in any of SEQ ID NOs: 39 to 62 or a complementary sequence thereof;

(4) a polynucleotide comprising at least 60 continuous nucleotides in the nucleotide sequence as shown in any of SEQ ID NOs: 39 to 62 or a sequence complementary thereto;

(5) a polynucleotide comprising a nucleotide sequence as shown in any of SEQ ID NOs: 63 to 100 and comprising at least 60 continuous nucleotides in the nucleotide sequence as shown in SEQ ID NOs: 1 to 38, respectively;

(6) a polynucleotide comprising a sequence complementary to a nucleotide sequence as shown in any of SEQ ID NOs: 63 to 100 and comprising at least 60 continuous nucleotides in the sequence complementary to the nucleotide sequence as shown in any of SEQ ID NOs: 1 to 38, respectively;

(7) a polynucleotide comprising a nucleotide sequence as shown in any of SEQ ID NOs: 101 to 124 and comprising at least 60 continuous nucleotides in the nucleotide sequence as shown in SEQ ID NOs: 39 to 62, respectively;

(8) a polynucleotide comprising a sequence complementary to a nucleotide sequence as shown in any of SEQ ID NOs: 101 to 124 and comprising at least 60 continuous nucleotides in the sequence complementary to the nucleotide sequence as shown in any of SEQ ID NOs: 39 to 62, respectively.

The polynucleotides or fragments thereof as used in the invention may be DNA or RNA.

Polynucleotides in the compositions of the present invention can be prepared by common techniques such as recombinant DNA technology, PCR, or a method involving the use of an automatic DNA/RNA synthesizer.

Recombinant DNA technology or PCR can involve the use of the techniques as disclosed in, for example, Ausubel. et al., Current Protocols in Molecular Biology, John Willey & Sons, US (1993); or Sambrook et al., Molecular Cloning: A Laboratory Manual, Cold Spring Harbor Laboratory Press, US (1989).

The human-derived EYA2, SERF1A, IGHG1, ITSN2, RAB11FIP5, HSPA1A, NMU, E2F3, ESR2, CFDP1, HSPC190, COL1A2, GCS1, PARL, CELSR2, NDRG1, SLC25A44, TUSC2, SLC4A1, MS4A7, TMSB4X, PRC1, VCP, RBM9, GPR126, HOXA10, PPP1R1A, MYO9B, SLCO4C1, SERPINB13, SDC2, TOR1A, RPL18A, GAS7, WISP1, CACNG4, S100P, UCHL5, AQP3, NSUN5, B4GALT2, CD48, DAB2, EBI3, MAP3K12, SPEN, ARHGEF3, COL3A1, CSTB, SPRR3, SLIT2, CAMK2B, SLC2A14, SATB2, SEPT6, GALNS, TROAP, XRCC3, FGF3, EIF4EBP2, RRM1, and M6PR genes are known, and the methods for obtaining the same are also known as described above. Thus, these genes can be cloned in order to prepare polynucleotides as the compositions of the present invention.

Polynucleotides constituting the composition of the present invention may be chemically synthesized using an automatic DNA synthesizer. Such synthesis is generally carried out by the phosphoramidite method, which enables the automatic synthesis of a single-stranded DNA of at most about 100 nucleotides. The automatic DNA synthesizer is commercially available from, for example, Polygen, ABI, or Applied BioSystems.

Also, the polynucleotides of the present invention can be prepared via cDNA cloning. Total RNA is extracted from a body tissue, such as esophageal tissue, in which the target gene of the present invention is expressed, the extracted total RNA is applied to the oligo dT cellulose column to obtain poly A(+) RNA, cDNA library is prepared therefrom via RT-PCR, and the target cDNA clone can be obtained from the resulting library via a screening method such as hybridization screening, expression screening, or antibody screening. If necessary, the cDNA clone may be amplified by PCR. A probe or primer can be selected and synthesized from any sequences comprising 15 to 100 continuous nucleotides in the nucleotide sequence as shown in any of SEQ ID NOs: 1 to 62. The cDNA cloning technique is described in, for example, Sambrook, J. & Russel, D., Molecular Cloning, A LABORATORY MANUAL, Cold Spring Harbor Laboratory Press, Jan. 15, 2001, vol. 1: 7.42 to 7.45, vol. 2: 8.9 to 8.17.

3.2 Kit for Diagnos of Esophageal Cancer (Antibody)

The present invention further provides a kit for diagnosis of esophageal cancer comprising one or more (preferably three or more) antibodies against a polypeptide having the amino acid sequence as shown in any of SEQ ID NOs: 125 to 162, a fragment thereof, or a chemically modified derivative thereof.

The kit of the present invention can further comprise one or more (preferably two or more) antibodies against a polypeptide having the amino acid sequence as shown in any of SEQ ID NOs: 163 to 186, fragments thereof, or chemically modified derivatives thereof. Use of such antibodies in combination can improve the accuracy for predicting prognosis.

Specifically, the present invention enables using one or more antibodies against the polypeptides alone or in combination, in order to detect polypeptides encoded by the genes shown below, homologs thereof, or mutants or derivatives thereof as the esophageal cancer markers; i.e., the polypeptides are encoded by the EYA2, SERF1A, IGHG1, ITSN2, RAB11FIP5, HSPA1A, NMU, E2F3, ESR2, CFDP1, HSPC190, COL1A2, GCS1, PARL, CELSR2, NDRG1, SLC25A44, TUSC2, SLC4A1, MS4A7, TMSB4X, PRC1, VCP, RBM9, GPR126, HOXA10, PPP1R1A, MYO9B, SLCO4C1, SERPINB13, SDC2, TOR1A, RPL18A, GAS7, WISP1, CACNG4, S100P, UCHL5, AQP3, NSUN5, B4GALT2, CD48, DAB2, EBI3, MAP3K12, SPEN, ARHGEF3, COL3A1, CSTB, SPRR3, SLIT2, CAMK2B, SLC2A14, SATB2, SEPT6, GALNS, TROAP, XRCC3, FGF3, EIF4EBP2, RRM1, and M6PR genes.

The above-mentioned polypeptides can be obtained by the recombinant DNA technology. For example, the cDNA clones obtained in the above-described manner are inserted into an expression vector, which is then transformed or transfected into procaryotic or eucaryotic host cells, and the resulting procaryotic or eucaryotic host cells are cultured. Thus, polypeptides of interest can be obtained from the cells or culture supernatants. Vectors and expression systems are commercially available from Novagen, Takara Shuzo, Daiichi Pure Chemicals, Qiagen, Stratagene, Promega, Roche Diagnostics, Invitrogen, Genetics Institute, or Amersham Bioscience. Examples of host cells that can be used are procaryotic cells such as bacteria (e.g., *E. coli* or *Bacillus subtilis*), yeast (e.g., *Saccharomyces cerevisiae*), insect cells (e.g., Sf cell), and mammalian cells (e.g., COS, CHO, and BHK cells). Vectors can comprise, in addition to DNA encoding each of the aforementioned polypeptides, regulatory elements such as promoter, enhancer, polyadenylation signal, ribosome-binding site, replication origin, terminator, and selection marker. In order to facilitate the purification of a polypeptide, further, a peptidic label may be added to the C- or N-terminus of the polypeptide to form a fusion polypeptide. Examples of representative peptidic labels include, but are not limited to, (histidine)$_{6-10}$ repeat, FLAG, myc peptide, and GFP polypeptide. The recombinant DNA techniques are described in Sambrook, J. & Russel, D. (supra).

When the polypeptide of the present invention is produced without the addition of a peptidic label, the polypeptide can be purified via, for example, ion-exchange chromatography. In addition, gel filtration, hydrophobic chromatography, isoelectric chromatography, or the like may be carried out in combination. When the protein has a peptidic label, such as histidine repeat, FLAG, myc, or GFP, affinity chromatography suitable for each peptidic label can be carried out in accordance with a conventional technique. Construction of an expression vector that facilitates isolation or purification is preferable. If the expression vector is constructed so as to express in the form of the fusion polypeptide of a polypeptide with a peptidic label and the resulting vector is used to prepare the polypeptide via a genetic engineering technique, isolation or purification of the polypeptide would become easy.

The thus-obtained antibody that recognizes the polypeptide can specifically bind to the polypeptide via an antigen-binding site of the antibody. Specifically, a polypeptide having an amino acid sequence as shown in any of SEQ ID NOs: 125 to 186, a fragment thereof, a mutant polypeptide, or a fusion polypeptide can be used as an immunogen to produce an immunoreactive antibody.

More specifically, the polypeptide, a fragment thereof, a mutant thereof, or a fusion polypeptide comprises an antigenic determinant or epitope that elicites antibody formation, and such antigen determinant or epitope may have a linear structure or a higher-order (or discontinued) structure. Such antigenic determinant or epitope can be identified by epitope analysis techniques known in the art.

The polypeptide of the present invention is capable of inducing an antibody of any form. If all, part, or an epitope of the polypeptide is isolated, a polyclonal or monoclonal antibody can be prepared in accordance with a conventional technique. An example of the method for preparing an antibody is described in Kennet et al. (ed.), Monoclonal Antibodies, Hybridomas: A New Dimension in Biological Analyses, Plenum Press, New York, 1980.

The antibody of the present invention is not particularly limited, provided that such antibody can bind specifically to the target polypeptide of the present invention or a fragment thereof. A monoclonal or polyclonal antibody may be used in the present invention, with a monoclonal antibody being preferable. The globulin type of the antibody of the present invention is not particularly limited, as long as the antibody has the aforementioned properties, and it may be any of IgG, IgM, IgA, IgE, or IgD.

<Preparation of Monoclonal Antibody>

(1) Immunization and Collection of Antibody-Producing Cell

The immunogen, which is a target polypeptide, is administered to a mammalian animal such as a rat, mouse (e.g., the inbred mouse strain Balb/c), or rabbit. The dose of the immunogen is appropriately determined depending on, for example, the type of an animal to be immunized or the route of administration, and it is about 50 to 200 μg per animal. Immunization is primarily performed by injecting an immunogen subcutaneously or intraperitoneally. The intervals of immunization are not particularly limited. After the primary immunization, boost immunization is carried out 2 to 10 times, and preferably 3 or 4 times, at the intervals of several days to several weeks, and preferably at the intervals of 1 to 4 weeks. After the primary immunization, the antibody titer in the blood serum of the immunized animal is repeatedly measured via, for example, enzyme-linked immuno sorbent assay (ELISA). When the antibody titer reached a plateau, the immunogen is injected intravenously or intraperitoneally to complete the final immunization. The antibody-producing cells are recovered 2 to 5 days, preferably 3 days, after the final immunization. Examples of antibody-producing cells include spleen cells, lymph node cells, and peripheral blood cells, preferably spleen cells or regional lymph node cells.

(2) Cell Fusion

Hybridoma cell lines that produce monoclonal antibodies specific for target polypeptides are prepared. Such hybridomas can be produced and identified via conventional techniques. The method for producing such hybridoma cell lines comprises immunizing an animal with the protein of the present invention, removing spleen cells from the immunized animal, fusing the spleen cells with myeloma cell lines, producing hybridoma cells therefrom, and identifying a hybridoma cell line that produces a monoclonal antibody binding to the protein of interest. Myeloma cell lines to be fused with antibody-producing cells can be commercially available established cell lines of animals such as mice. Preferably, cell lines to be used have drug selectivity; namely, they cannot survive in the HAT selection medium (containing hypoxanthine, aminopterin, and thymidine) in an unfused state, while they can survive only in a state fused with antibody-producing cells. The established cells are preferably derived from an animal of the same species with the animal to be immunized. A specific example of the myeloma cell line is the P3×63-Ag.8 strain (ATCC TIB9), which is a BALB/c mouse-derived hypoxanthine guanine phosphoribosyltransferase (HGPRT) deficient cell line.

Subsequently, the myeloma cell lines are fused with the antibody-producing cells. Cell fusion is carried out in a serum-free medium for animal cell culture, such as DMEM or RPMI-1640 medium, by mixing the antibody-producing cells with the myeloma cell lines at a ratio of about 1:1 to 20:1 in the presence of a cell fusion accelerator. As the cell fusion accelerator, polyethylene glycol having an average molecular weight of 1,500 to 4,000 daltons can be used at a concentration of about 10 to 80%, for example. Optionally, an auxiliary agent, such as dimethyl sulfoxide, can be used in combination in order to enhance the fusion efficiency. Further, the antibody-producing cells can be fused with the myeloma cell lines by using a commercially available cell fusion apparatus utilizing electric stimulus (e.g., electroporation).

(3) Selection and Cloning of Hybridomas

The hybridomas of interest are selected from the fused cells. To this end, the cell suspension is adequately diluted in, for example, a fetal bovine serum-containing RPMI-1640 medium, the suspension is aliquoted into each well of a microtiter plate at about two million cells/well, a selection medium is added to the wells, and culture is then carried out while appropriately exchanging the selection medium with a fresh medium. The culture temperature is 20° C. to 40° C., and preferably about 37° C. When the myeloma cell is an HGPRT-deficient strain or thymidine kinase-deficient strain, a hybridoma of a cell having an ability to produce an antibody with a myeloma cell line can selectively be cultured and grown in the selection medium containing hypoxanthine, aminopterin, and thymine (i.e., the HAT medium). As a result, cells grown about 14 days after the initiation of culture in the selection medium can be obtained as the hybridomas.

Subsequently, whether or not the culture supernatant of the grown hybridomas contains the antibody of interest is screened for. Hybridomas can be screened for in accordance with a conventional technique, without particular limitation. For example, the culture supernatant in the well containing the grown hybridomas is partially sampled and then subjected to enzyme immuno assay (EIA), ELISA, radio immuno assay (RIA), or other means. The fused cells are cloned using the limiting dilution method or the like, and monoclonal antibody-producing cells, i.e. hybridomas, are established in the end. The hybridoma of the present invention is stable during the culture in a basic medium, such as RPMI-1640 or DMEM, as described below, and the hybridoma can produce and secrete a monoclonal antibody that reacts specifically with a target polypeptide.

(4) Recovery of Antibody

A monoclonal antibody can be recovered via a conventional technique. Specifically, a monoclonal antibody can be collected from the established hybridoma via a conventional cell culture technique, ascites development, or other means. According to the cell culture technique, hybridoma is cultured in an animal cell culture medium, such as 10% fetal bovine serum-containing RPMI-1640 medium, MEM medium, or a serum-free medium, under common culture conditions (e.g., 37° C., 5% $CO_2$) for 2 to 10 days, and the antibody is obtained from the culture supernatant. In the case of the ascites development, about 10 millions of myeloma-derived hybridomas cells are administered intraperitoneally to an animal, which is of the same species as the mammal from which the myeloma cell is derived, so as to allow the hybridoma cells to grow in a large quantity. After one to two weeks, the ascites or blood serum is collected from the animal.

When the purification of an antibody is required in the above-described method for collecting the antibody, the conventional techniques, such as salting out by ammonium sulfate, ion-exchange chromatography, affinity chromatography, and gel chromatography, may be appropriately selected or combined to obtain the purified monoclonal antibody.

<Preparation of Polyclonal Antibody>

When a polyclonal antibody is prepared, an animal such as a rabbit is immunized in the same manner as described above, the antibody titer is measured 6 to 60 days after the final immunization via enzyme immunoassay (EIA or ELISA) or radio immunoassay (RIA), and blood is taken on the day the maximal antibody titer is measured, in order to obtain the antiserum. Thereafter, the reactivity of the polyclonal antibody in the antiserum is assayed via ELISA or other means.

<Detection Method>

The present invention provides a method for determining in vitro whether or not the test sample from a subject contains esophageal cancer cells comprising assaying in vitro the polypeptide levels in biological samples obtained from a subject, such as esophageal cancer cells or blood, with the use of the antibodies of the present invention.

Examples of immunological assay techniques include enzyme immunoassay (ELISA or EIA), fluorescence immunoassay, radio immunoassay (RIA), luminescent immunoassay, immunonephelometry, latex agglutination assay, latex turbidimetry, hemagglutination, particle agglutination, and Western blotting.

When the above method is carried out via an immunoassay technique using a label, the antibody of the present invention may be immobilized, or a component in the sample may be immobilized to subject such substance to an immunological reaction.

Examples of solid-phase supports that can be used include insoluble supports in the form of beads, microplate, test tube, stick, or test strip, made of polystyrene, polycarbonate, polyvinyltoluene, polypropyrene, polyethylene, polyvinyl chloride, nylon, polymethacrylate, latex, gelatin, agarose, cellulose, sepharose, glass, metal, ceramic, or magnetic material.

The samples can be immobilized on the support in accordance with a conventional technique by binding the antibody of the present invention or a sample component to the solid-phase support via physical adsorption, chemical binding, or combination thereof.

The present invention is intended to easily detect the reaction between the antibody of the present invention and the target polypeptide in the sample. To this end, the antibody of the present invention is labeled to directly detect the reaction of interest. Alternatively, a labeled secondary antibody is used to indirectly detect the reaction. In the method of detection according to the present invention, the latter indirect detection technique (e.g., the sandwich technique) is preferably employed from the viewpoint of sensitivity.

Examples of label substances that can be used for enzyme immunoassay include peroxidase (POD), alkaline phosphatase, β-galactosidase, urease, catalase, glucose oxidase, lactate dehydrogenase, amylase, and a biotin-avidin complex. Examples of the labels that can be used for fluorescence immunoassay include fluorescein isothiocyanate, tetramethylrhodamine isothiocyanate, substituted rhodamine isothiocyanate, dichlorotriazine isothiocyanate, Alexa, and AlexaFluoro. Examples of label substances that can be used for radio immunoassay include tritium and iodine$^{125}$ or iodine$^{131}$. Examples of the labels that can be used for luminescent immunoassay include NADH-, FMNH2-, the luciferase system, the luminol-hydrogen peroxide-POD system, the acridinium ester system, and the dioxetane compound system.

A label can be bound to the antibody in case of enzyme immunoassay, for example, via a conventional technique, such as the glutaraldehyde method, the maleimide method, the pyridyl disulfide method, or the periodic acid method. Radio immunoassay can be carried out in accordance with a conventional technique, such as the chloramine-T method or Bolton-Hunter method. Such assay techniques can be carried out in accordance with conventional techniques (Current protocols in Protein Sciences, 1995, John Wiley & Sons Inc., Current protocols in Immunology, 2001, John Wiley & Sons Inc.). When the antibody of the present invention is directly labeled, for example, a component in the sample is immobilized on a solid phase and brought into contact with the labeled antibody of the present invention to form a complex of the marker polypeptide and the antibody of the present invention. The unbound labeled antibody is separated by washing, and the amount of the target polypeptide in the sample can be determined based on the amount of the bound labeled antibody or the unbound labeled antibody.

When the labeled secondary antibody is used, for example, the antibody of the present invention is allowed to react with a sample (the primary reaction) and then with the labeled secondary antibody (the secondary reaction). The primary reaction and the secondary reaction may be carried out in the reverse order, concurrently, or separately. The primary and secondary reactions result in the formation of a complex of immobilized target polypeptide/the antibody of the invention/labeled secondary antibody or a complex of the immobilized antibody of the invention/target polypeptide/labeled secondary antibody. The unbound labeled secondary antibody is separated by washing, and the amount of target polypeptide in the sample can be determined based on the amount of the bound labeled secondary antibody or of the unbound labeled secondary antibody.

In the enzyme immunoassay, specifically, the enzyme label is allowed to react with a substrate under optimal conditions, and the amount of the reaction product is assayed by an optical method or the like. In the fluorescence immunoassay, the fluorescent intensity generated via fluorescent labeling is assayed. In the radio immunoassay, the radioactivity generated via radioactive labeling is assayed. In the luminescent immunoassay, the luminescent level generated via a luminescent reaction system is assayed.

In the method of the present invention, generation of immune-complex aggregates in immunonephelometry, latex agglutination assay, latex turbidimetry, hemagglutination, particle agglutination, or the like is assayed by optically measuring the transmitted beam or scattered beam. When visually assayed, a solvent, such as a phosphate, glycine, Tris, or Good's buffer, can be used. Further, a reaction accelerator such as polyethylene glycol or an inhibitor of nonspecific reaction may be added to the reaction system.

The antibodies comprised in the kit of the present invention can be present singly or in the form of a mixture. Alternatively, the antibodies may be bound onto a solid-phase carrier or may be in the free form. Further, the kit of the present invention can comprise a labeled secondary antibody, a carrier, a washing buffer, a sample diluent, a substrate for enzyme, a reaction terminator, a marker (target) polypeptide(s) as purified standard(s), instructions, and so on.

4. Kit for Diagnosis of Esophageal Cancer (Nucleic Acid)

The present invention provides a kit for diagnosis (or detection) of esophageal cancer comprising one or more (preferably three or more, and more preferably five or more) of the polynucleotides contained in the composition of the present invention, mutants thereof, and/or fragments thereof.

The kit of the present invention preferably comprises one or more polynucleotides selected from the group consisting of the polynucleotides or fragments thereof described in §3.1 above.

The kit of the present invention can comprise at least three of polynucleotides each comprising a nucleotide sequence as shown in any of SEQ ID NOs: 1 to 38, polynucleotides each comprising a sequence complementary thereto, polynucleotides each hybridizing under stringent conditions to any of the polynucleotides, or fragments thereof.

The kit of the present invention can comprise at least two of polynucleotides each comprising a nucleotide sequence as shown in any of SEQ ID NOs: 39 to 62, polynucleotides each comprising a sequence complementary thereto, polynucleotides each hybridizing under stringent conditions to any of the polynucleotides, or fragments thereof.

Fragments of the polynucleotides, which can be comprised in the kit of the invention, are, for example, at least 5 DNAs selected from the group consisting of (1) to (5) below:

(1) DNA comprising at least 15 continuous nucleotides in the nucleotide sequence as shown in any of SEQ ID NOs: 1 to 62 or a sequence complementary thereto;

(2) DNA comprising at least 60 continuous nucleotides in the nucleotide sequence as shown in any of SEQ ID NOs: 1 to 62 or a sequence complementary thereto;

(3) DNA comprising the nucleotide sequence as shown in any of SEQ ID NOs: 63 to 124 or a sequence complementary thereto and comprising at least 60 continuous nucleotides in the nucleotide sequence as shown in any of SEQ ID NOs: 1 to 62, respectively, or a sequence complementary thereto;

(4) DNA consisting of the nucleotide sequence as shown in any of SEQ ID NOs: 63 to 124; or (5) DNA comprising a nucleotide sequence complementary to the nucleotide sequence as shown in any of SEQ ID NOs: 63 to 124.

According to a preferable embodiment, the polynucleotide is a polynucleotide consisting of a nucleotide sequence as shown in any of SEQ ID NOs: 1 to 38, a polynucleotide consisting of a complementary sequence thereof, a polynucleotide hybridizing under stringent conditions to the polynucleotide, or a fragment comprising at least 15, preferably at least 20, and more preferably at least 25 continuous nucleotides thereof.

According to another preferable embodiment, the kit of the present invention can further comprise, in addition to the above polynucleotide, a polynucleotide consisting of the nucleotide sequence as shown in SEQ ID NO: 47, a polynucleotide consisting of a complementary sequence thereof, a polynucleotide hybridizing under stringent conditions to the polynucleotide, or a fragment thereof comprising at least 15 continuous nucleotides.

According to a preferable embodiment, the fragment can be a polynucleotide comprising at least 15, preferably at least 20, more preferably at least 25, and further preferably at least 60 continuous nucleotides.

According to another preferable embodiment, the fragment is a polynucleotide comprising a nucleotide sequence as shown in any of SEQ ID NOs: 63 to 124 and comprising at least 60 continuous nucleotides in the nucleotide sequence as shown in any of SEQ ID NOs: 1 to 62, respectively, or a polynucleotide comprising a nucleotide sequence complementary thereto.

According to another preferable embodiment, the fragment is a polynucleotide comprising a nucleotide sequence as shown in any of SEQ ID NOs: 63 to 124.

According to another preferable embodiment, the fragment is a polynucleotide comprising a nucleotide sequence complementary to a nucleotide sequence as shown in any of SEQ ID NOs: 63 to 124.

According to another preferable embodiment, the fragment is a polynucleotide consisting of a nucleotide sequence as shown in any of SEQ ID NOs: 63 to 124.

Examples of such combination are combinations of genes shown in Table 1 below in the order of from higher priority to lower priority (i.e., from the 1st gene to the 62nd gene) regarding polynucleotides comprising the nucleotide sequences as shown in SEQ ID NOs: 1 to 62 or sequences complementary thereto, polynucleotides hybridizing under stringent conditions to such polynucleotides, and/or fragments thereof (e.g., SEQ ID NOs: 63 to 124). When the probability of detecting the presence of esophageal cancer (%) attained when combining such 62 types of genes in such a manner is plotted relative to the number of genes necessary for the detection of esophageal cancer, the probability is, for example, 42.1% for SPRR3 (SEQ ID NO: 50) alone, 52.6% for a combination of SPRR3 (SEQ ID NO: 50) and CSTB (SEQ ID NO: 49), 59.6% for a combination of SPRR3 (SEQ ID NO: 50), CSTB (SEQ ID NO: 49), and EYA2 (SEQ ID NO: 1), 59.7% for a combination of SPRR3 (SEQ ID NO: 50), CSTB (SEQ ID NO: 49), EYA2 (SEQ ID NO: 1), and SERF1A (SEQ ID NO: 2), and 86.0% for a combination of SPRR3 (SEQ ID NO: 50), CSTB (SEQ ID NO: 49), EYA2 (SEQ ID NO: 1), SERF1A (SEQ ID NO: 2), and IGHG1 (SEQ ID NO: 3). When all 62 types of genes are combined in the same manner, the probability would be 96.5% (FIG. 1).

The minimal combination that is preferable in an embodiment of the present invention is a combination of SPRR3 (SEQ ID NO: 50), CSTB (SEQ ID NO: 49), EYA2 (SEQ ID NO: 1), SERF1A (SEQ ID NO: 2), and IGHG1 (SEQ ID NO: 3). Polynucleotides constituting the same or fragments thereof are selected from polynucleotides comprising the nucleotide sequences as shown in SEQ ID NO: 50, 49, 1, 2, and 3 or sequences complementary thereto, polynucleotides hybridizing under stringent conditions to such polynucleotides, and/or fragments thereof. Other genes shown in Table 1 can be added to the 5 types of genes above, whereby the probability can be elevated to, for example, 89% or higher, 91% or higher, 92% or higher, or 96% or higher.

According to another more preferable embodiment, the kit of the present invention can comprise at least 3 (preferably at least 5) to all polynucleotides of the polynucleotides each comprising a nucleotide sequence as shown in any of SEQ ID NOs: 63 to 124 or a sequence complementary thereto.

According to the present invention, the size of fragments of the polynucleotides is, for example, continuous 15 to all nucleotides, 15 to 5,000 nucleotides, 15 to 4,500 nucleotides, 15 to 4,000 nucleotides, 15 to 3,500 nucleotides, 15 to 3,000 nucleotides, 15 to 2,500 nucleotides, 15 to 2,000 nucleotides, 15 to 1,500 nucleotides, 15 to 1,000 nucleotides, 15 to 900 nucleotides, 15 to 800 nucleotides, 15 to 700 nucleotides, 15 to 600 nucleotides, 15 to 500 nucleotides, 15 to 400 nucleotides, 15 to 300 nucleotides, 15 to 250 nucleotides, 15 to 200 nucleotides, 15 to 150 nucleotides, 15 to 140 nucleotides, 15 to 130 nucleotides, 15 to 120 nucleotides, 15 to 110 nucleotides, 15 to 100 nucleotides, 15 to 90 nucleotides, 15 to 80 nucleotides, 15 to 70 nucleotides, 15 to 60 nucleotides, 15 to 50 nucleotides, 15 to 40 nucleotides, 15 to 30 nucleotides, or 15 to 25 nucleotides; 25 to all nucleotides, 25 to 1,000 nucleotides, 25 to 900 nucleotides, 25 to 800 nucleotides, 25 to 700 nucleotides, 25 to 600 nucleotides, 25 to 500 nucleotides, 25 to 400 nucleotides, 25 to 300 nucleotides, 25 to 250 nucleotides, 25 to 200 nucleotides, 25 to 150 nucleotides, 25 to 140 nucleotides, 25 to 130 nucleotides, 25 to 120 nucleotides, 25 to 110 nucleotides, 25 to 100 nucleotides, 25 to 90 nucleotides, 25 to 80 nucleotides, 25 to 70 nucleotides, 25 to 60 nucleotides, 25 to 50 nucleotides, or 25 to 40 nucleotides; 50 to all nucleotides, 50 to 1,000 nucleotides, 50 to 900 nucleotides, 50 to 800 nucleotides, 50 to 700 nucleotides, 50 to 600 nucleotides, 50 to 500 nucleotides, 50 to 400 nucleotides, 50 to 300 nucleotides, 50 to 250 nucleotides, 50 to 200 nucleotides, 50 to 150 nucleotides, 50 to 140 nucleotides, 50 to 130 nucleotides, 50 to 120 nucleotides, 50 to 110 nucleotides, 50 to 100 nucleotides, 50 to 90 nucleotides, 50 to 80 nucleotides, 50 to 70 nucleotides, or 50 to 60 nucleotides; or 60 to all nucleotides, 60 to 1,000 nucleotides, 60 to 900 nucleotides, 60 to 800 nucleotides, 60 to 700 nucleotides, 60 to 600 nucleotides, 60 to 500 nucleotides, 60 to 400 nucleotides, 60 to 300 nucleotides, 60 to 250 nucleotides, 60 to 200 nucleotides, 60 to 150 nucleotides, 60 to 140 nucleotides, 60 to 130 nucleotides, 60 to 120 nucleotides, 60 to 110 nucleotides, 60 to 100 nucleotides, 60 to 90 nucleotides, 60 to 80 nucleotides, or 60 to 70 nucleotides, in the nucleotide sequence of each polynucleotide.

It should be noted that the above combinations that constitute the kit of the present invention are exemplary, and any other combinations fall within the scope of the present invention.

The kit of the present invention can comprise, in addition to the polynucleotides of the present invention, mutants thereof, or fragments thereof as described above, known or newly found polynucleotides that enable detection of esophageal cancer.

Polynucleotides comprised in the kit of the present invention, mutants thereof, or fragments thereof can be packaged in different containers separately or appropriately in combination.

5. DNA Chip

The present invention further provides a DNA chip for diagnosis of esophageal cancer comprising the same polynucleotides as those contained in the composition and/or the kit of the present invention (or polynucleotides described in §3.1 "Composition" and/or §4 "Kit"), mutants thereof, fragments thereof, and combinations thereof.

A substrate of the DNA chip is not particularly limited, provided that the substrate can comprise DNAs immobilized thereon. Examples of the substrate include a glass slide, a silicon chip, a polymer chip, and a nylon membrane. Such substrate may be subjected to surface treatment, for example, poly-L-lysine coating or introduction of a functional group such as an amino group or carboxyl group.

DNAs can be immobilized on a substrate by any common technique without particular limitation. Examples of such technique include a method of spotting DNA using a high-density dispenser, called a spotter or arrayer, a method of spraying DNA on a substrate using an apparatus (i.e., inkjet), which jets fine droplets from a nozzle by a piezoelectric element, and a method of synthesizing nucleotides successively on a substrate. When the high-density dispenser is used, for example, different gene solutions are first placed into each well of a multiwell plate, and the solutions are taken out of the plate using a pin (i.e., needle) and are successively spotted on the substrate. According to the inkjet technique, genes are jetted through a nozzle, and the genes are arrayed on the substrate at a high speed. In the DNA synthesis on the substrate, a nucleotide on the substrate is protected with a functional group, which is capable of leaving from the substrate by light or heat, and light or heat is selectively applied to a nucleotide at a specific position by using a mask, thereby deprotecting the functional group. Thereafter, nucleotides are added to the reaction solution, such nucleotides are coupled to the nucleotides on the substrate, and this srep is repeated.

Polynucleotides to be immobilized are the polynucleotides of the present invention as described above.

Examples of such polynucleotides can comprise one or more (preferably five or more) of the following polynucleotides or fragments thereof:

(1) polynucleotides each consisting of the nucleotide sequence as shown in any of SEQ ID NOs: 1 to 62, mutants thereof, or fragments thereof each comprising at least 15 continuous nucleotides;

(2) polynucleotides each comprising a nucleotide sequence as shown in any of SEQ ID NOs: 1 to 62;

(3) polynucleotides each consisting of the nucleotide sequence as shown in any of SEQ ID NOs: 1 to 38, mutants thereof, or fragments thereof each comprising at least 15 continuous nucleotides;

(4) polynucleotides each comprising a nucleotide sequence as shown in any of SEQ ID NOs: 1 to 38, mutants thereof, or fragments thereof each comprising at least 15 continuous nucleotides;

(5) polynucleotides each consisting of a nucleotide sequence complementary to the nucleotide sequence as shown in any of SEQ ID NOs: 1 to 38, mutants thereof, or fragments thereof each comprising at least 15 continuous nucleotides;

(6) polynucleotides each comprising a nucleotide sequence complementary to the nucleotide sequence as shown in any of SEQ ID NOs: 1 to 38;

(7) polynucleotides each hybridizing under stringent conditions to DNA consisting of a nucleotide sequence complementary to the nucleotide sequence as shown in any of SEQ ID NOs: 1 to 38 or fragments thereof each comprising at least 15 continuous nucleotides;

(8) polynucleotides each hybridizing under stringent conditions to DNA consisting of the nucleotide sequence as shown in any of SEQ ID NOs: 1 to 38 or fragments thereof each comprising at least 15 continuous nucleotides;

(9) polynucleotides each consisting of the nucleotide sequence as shown in any of SEQ ID NOs: 39 to 62, mutants thereof, or fragments thereof each comprising at least 15 continuous nucleotides;

(10) polynucleotides each comprising a nucleotide sequence as shown in any of SEQ ID NOs: 39 to 62, mutants thereof, or fragments thereof each comprising at least 15 continuous nucleotides;

(11) polynucleotides each consisting of a nucleotide sequence complementary to the nucleotide sequence as shown in any of SEQ ID NOs: 39 to 62, mutants thereof, or fragments thereof each comprising at least 15 continuous nucleotides;

(12) polynucleotides each comprising a nucleotide sequence complementary to the nucleotide sequence as shown in any of SEQ ID NOs: 39 to 62;

(13) polynucleotides each hybridizing under stringent conditions to DNA consisting of a nucleotide sequence complementary to the nucleotide sequence as shown in any of SEQ ID NOs: 39 to 62 or fragments thereof each comprising at least 15 continuous nucleotides;

(14) polynucleotides each hybridizing under stringent conditions to DNA consisting of the nucleotide sequence as shown in any of SEQ ID NOs: 39 to 62 or fragments thereof each comprising at least 15 continuous nucleotides;

(15) a polynucleotide comprising at least 15 continuous nucleotides in the nucleotide sequence as shown in any of SEQ ID NOs: 1 to 38 or a sequence complementary thereto;

(16) a polynucleotide comprising at least 60 continuous nucleotides in the nucleotide sequence as shown in any of SEQ ID NOs: 1 to 38 or a sequence complementary thereto;

(17) a polynucleotide comprising at least 15 continuous nucleotides in the nucleotide sequence as shown in any of SEQ ID NOs: 39 to 62 or a sequence complementary thereto;

(18) a polynucleotide comprising at least 60 continuous nucleotides in the nucleotide sequence as shown in any of SEQ ID NOs: 39 to 62 or a sequence complementary thereto;

(19) a polynucleotide comprising the nucleotide sequence as shown in any of SEQ ID NOs: 63 to 100 and comprising at least 60 continuous nucleotides in the nucleotide sequence as shown in any of SEQ ID NOs: 1 to 38, respectively;

(20) a polynucleotide comprising a sequence complementary to the nucleotide sequence as shown in any of SEQ ID NOs: 63 to 100 and comprising at least 60 continuous nucleotides in a nucleotide sequence complementary to the nucleotide sequence as shown in any of SEQ ID NOs: 1 to 38, respectively;

(21) a polynucleotide comprising the nucleotide sequence as shown in any of SEQ ID NOs: 101 to 124 and comprising at least 60 continuous nucleotides in the nucleotide sequence as shown in any of SEQ ID NOs: 39 to 62, respectively; and

(22) a polynucleotide comprising a sequence complementary to the nucleotide sequence as shown in any of SEQ ID NOs: 101 to 124 and comprising at least 60 continuous nucleotides in a sequence complementary to the nucleotide sequence as shown in any of SEQ ID NOs: 39 to 62, respectively.

According to a preferable embodiment, the DNA chip of the present invention can comprise at least 5 to all polynucleotides each comprising a nucleotide sequence as shown in any of SEQ ID NOs: 63 to 124 or a complementary sequence thereof.

According to the present invention, the polynucleotides to be immobilized may be any of genomic DNA, cDNA, RNA, synthetic DNA, and synthetic RNA, and they may be single-stranded or double-stranded.

Examples of DNA chips that can detect or determine the expression levels of the target genes, RNAs, or cDNAs include the 3D-Gene (Toray Industries, Inc.), the Gene Chip Human Genome U133 Plus 2.0 Array (Affymetrix), the Whole human genome oligo microarray (Agilent), and the IntelliGene® HS Human Expression CHIP (Takara Bio).

DNA chips can be prepared by, for example, a method wherein probes that have been prepared in advance are immobilized on the surface of a solid-phase. In this method, polynucleotides into which functional groups have been introduced are synthesized, and oligonucleotides or polynucleotides are spot-deposited on the surface of a surface-treated solid-phase support, followed by covalently binding them (e.g., J. B. Lamture et al., Nucleic. Acids. Research, 1994, vol. 22, pp. 2121-2125; Z. Guo et al., Nucleic. Acids. Research, 1994, vol. 22, pp. 5456-5465). In general, the polynucleotides are covalently bound to the surface-treated solid-phase support via a spacer or crosslinker. The method wherein fine pieces of polyacrylamide gel are aligned on the glass surface and synthetic polynucleotides are covalently bound thereto is also known (G. Yershov et al., Proceedings of the National Academic Sciences, U.S.A., 1996, vol. 94, p. 4913). Also, a method in which a microelectrode array is prepared on a silica microarray, a permeable layer of streptavidin-containing agarose is formed on the electrode to prepare a reaction site, this site is positively charged to immobilize the biotinylated polynucleotides thereon, and the charge at the site is regulated so as to enable hybridization under stringent conditions at a high speed is known (R. G. Sosnowski et al., Proceedings of the National Academic Sciences, U.S.A., 1997, vol. 94, pp. 1119-1123).

6. Method for Detection of Esophageal Cancer

The present invention provides a method for determining in vitro whether or not samples to be tested contain esophageal cancer cells with the use of the composition, kit, DNA chip of the present invention or a combination thereof. The method comprises: comparing the gene expression levels in the samples with the use of esophageal cancer cells and non-cancerous cells obtained from esophageal cancer patients at the time or surgery or endoscopy; and, when the expression levels of the target nucleic acids of cells in the samples are increased or decreased, determining that the sample contains esophageal cancer cells, wherein the target nucleic acids can be detected with the use of polynucleotides comprised in the composition, kit, or DNA chip, mutants thereof, or fragments thereof.

The present invention also provides a use of the composition, kit, or DNA chip of the present invention for in vivo detection of esophageal cancer in a sample obtained from a subject.

The method of the present invention comprises the use of the composition, kit, or DNA chip comprising the polynucleotides of the present invention, mutants thereof, or fragments thereof alone or in any possible combination, as described above.

The polynucleotides, mutants thereof, or fragments thereof that are comprised in the composition, kit, or DNA chip of the present invention can be used as primers or probes for detection, determination (or identification), or (genetic) diagnosis of esophageal cancer of the present invention. When used as primers, for example, primers comprising generally 15 to 50 nucleotides, preferably 15 to 30 nucleotides, and more preferably 18 to 25 nucleotides can be used. When used as detection probes, for example, polynucleotides comprising 15 to all nucleotides, preferably 25 to 1,000 nucleotides, more preferably 25 to 100 nucleotides can be used. It should be noted that the number of nucleotides is not limited to such ranges.

The polynucleotides, mutants thereof, or fragments thereof that are contained in the composition or kit of the present invention can be used as primers or probes in accordance with conventional techniques in known methods that specifically detect a given gene (e.g., Northern blotting, Southern blotting, RT-PCR, in situ hybridization, or Southern hybridization). As to samples to be tested (or analytes), the whole or part of the esophageal tissue or the body tissue suspected of having esophageal cancer cells from a subject may be removed via biopsy or other means, or the samples may be removed from the body tissue excised via surgery, depending on types of detection methods to be employed. Further, total RNA prepared therefrom in accordance with a conventional technique may be used, or various polynucleotides including cDNA or poly A(+) RNA prepared from such RNA may be used.

Also, the expression levels of nucleic acids such as the genes, RNAs, or cDNAs of the present invention in the body tissues can be detected or quantified using a DNA chip (including a DNA microarray). In this case, the composition or kit of the present invention can be used as DNA chip probes (e.g., the Human Genome U133 Plus 2.0 Array (Affymetrix) uses polynucleotide probes having 25 nucleotides). Such a DNA chip may be hybridized to the labeled DNAs or RNAs, which are prepared from RNAs removed from the body tissue, and a complex of the probe with the labeled DNA or RNA resulting from such hybridization may be detected using the labeled DNA or RNA as an indicator to evaluate the presence or absence of the expression of the esophageal cancer-associated genes or the expression levels thereof in the body tissue. In the method of the present invention, a DNA chip is preferably used. This enables the simultaneous evaluation of the presence or absence of the expression of a plurality of genes or the simultaneous evaluation of the expression levels of the genes in a single biological sample.

The composition, kit, or DNA chip of the present invention is useful for diagnosing, determining, or detecting esophageal cancer (e.g., diagnosis of affection or degree of affection). Specifically, esophageal cancer can be diagnosed using the composition, kit, or DNA chip in the following manner. That is, the gene expression levels in samples are compared with the use of esophageal cancer cells and non-cancerous cells obtained from an esophageal cancer patient at the time of surgery or endoscopy examination, or esophageal cancer cells obtained from an esophageal cancer patient are compared with a body tissue equivalent to non-cancerous cells at the time of surgery or endoscopy examination in order to determine differences in gene expression levels detected with the use of such diagnostic composition. In this case, the term "differences in gene expression levels" refers to not only the presence or absence of expression but also the case in which differences are observed in gene expression, even when the gene expression is observed both in esophageal cancer cells and non-cancerous cells obtained from an esophageal cancer patient. For example, the expression of the EYA2 gene is induced or decreased in the presence of esophageal cancer, and thus, this gene is expressed or decreased in the esophageal cancer tissue of the subject. If differences are observed in the expression level in the cancer tissue and in the normal esophageal tissue, whether or not the sample contains esophageal cancer cells can be determined.

A method for detecting whether or not the test sample (or specimen) contains esophageal cancer cells using the composition, kit, or DNA chip of the present invention comprises: removing the whole or part of the body tissue from a subject via biopsy or recovering it from the body tissue excised via surgery; detecting the genes contained therein using a polynucleotide or polynucleotides selected from among the polynucleotides of the present invention, mutants thereof, or fragments thereof; measuring expression levels of the genes; and diagnosing the presence or absence of esophageal cancer or a degree of esophageal cancer. Also, the method for detecting esophageal cancer according to the present invention can detect, determine, or diagnose the occurrence or degree of amelioration of the disease when a therapeutic agent is administered to an esophageal cancer patient, for example.

The method of the present invention can comprise, for example, the following steps (a), (b), and (c) of:

(a) bringing a test sample (or specimen) of a subject into contact with polynucleotides comprised in the composition, kit, or DNA chip of the present invention;

(b) measuring expression levels of target nucleic acids in the test sample using the polynucleotides as the probes; and (c) determining the presence or absence of esophageal cancer (cells) in the test sample based on the results obtained in step (b).

Examples of test samples (or specimens) used in the method of the present invention include samples prepared from body tissues of a subject, such as esophageal tissue, peripheral tissue thereof, and tissue suspected of having esophageal cancer. Specifically, an RNA-containing sample prepared from such tissue or a sample containing polynucleotides further prepared therefrom may be prepared by removing (or sampling) the whole or part of the body tissue from the subject via biopsy or recovering the sample from the body tissue excised via surgery, so as to prepare the sample therefrom in accordance with conventional techniques.

The term "subject" as used herein refers to a mammal. Examples thereof include, but are not limited to, human, monkey, mouse, and rat, preferably human.

In the method of the present invention, the above-mentioned steps may be varied depending on types of biological samples used as analytes.

When RNA is used as the analyte, detection of esophageal cancer (cells) can comprise, for example, the following steps (a), (b), and (c) of:

(a) allowing RNAs prepared from a biological sample of a subject or a complementary polynucleotides (cDNAs) transcribed therefrom to bind to polynucleotides comprised in the composition, kit, or DNA chip of the present invention;

(b) measuring the RNAs prepared from the biological sample bound to the polynucleotides or complementary polynucleotides transcribed from the RNAs using the above polynucleotides as probes; and (c) determining the presence or absence of esophageal cancer (cells) based on the results obtained in step (b).

In order to detect, determine, or diagnose the esophageal cancer (cells) by the present invention, for example, various hybridization techniques can be employed. Examples of the hybridization techniques that can be employed include Northern blotting, Southern blotting, RT-PCR, DNA chip analysis, in situ hybridization, and Southern hybridization.

When Northern blotting is employed, the diagnostic composition of the present invention can be used as a probe to detect and measure the presence or absence of each gene expression in RNA or the expression level thereof. Specifically, the diagnostic composition (specifically, containing complementary strands) of the present invention is labeled with a radioisotope (e.g., $^{32}P$, $^{33}P$, or $^{35}S$) or a fluorophore, the resultant product is hybridized to the RNA obtained from a body tissue of a subject that has been transferred onto a nylon membrane or the like in accordance with conventional techniques, the resulting double-strand of the diagnostic composition (i.e., DNA) and the RNA can be detected and measured by detecting a signal derived from the label (a radioisotope or fluorophore) of the diagnostic composition using a radio detector (e.g., BAS-1800 II, Fuji Photo Film) or a fluorescent detector (STORM 860, Amersham Bioscience).

When the quantitative RT-PCR is employed, the diagnostic composition of the present invention can be used as primers to detect and measure the presence or absence of the gene expression in RNA or the expression level thereof. Specifically, cDNA is prepared from RNA of a body tissue of a subject in accordance with conventional techniques, a pair of primers prepared from the diagnostic composition of the present invention (i.e., a forward strand and a reverse strand, both binding to the cDNA) is hybridized to the cDNA to perform PCR using the cDNA as a template in accordance with conventional techniques, thereby amplifying a target gene region, and the resulting double-stranded DNA is detected. Double-stranded DNA can be detected by a method wherein PCR is carried out using primers that have been labeled with a radioisotope or fluorophore in advance, a method wherein the PCR product is electrophoresed on agarose gel, and double-stranded DNA is detected by staining the same with ethidium bromide or the like, or a method wherein the resulting double-stranded DNA is transferred to a nylon membrane or the like in accordance with conventional techniques, and the resultant is subjected to hybridization to the labeled diagnostic composition as a probe to detect a substance of interest.

When the DNA chip analysis is employed, the DNA chip comprising the diagnostic composition of the present invention as DNA probes (single-stranded or double-stranded) attached to a substrate, is used. The substrate comprising genes immobilized thereon is generally referred to as a DNA chip or DNA array. Examples of the DNA array include DNA macroarray and DNA microarray. As used herein, the term "DNA chip" is also intended to include such DNA arrays.

Hybridization conditions are not particularly limited. For example, hybridization is carried out in 3 to 4×SSC and 0.1% to 0.5% SDS at 30° C. to 50° C. for 1 to 24 hours, more preferably in 3×SSC and 0.3% SDS at 40° C. to 45° C. for 1 to 24 hours, followed by washing. Washing is continuously carried out, for example, with a solution containing 3×SSC and 0.1% SDS at 30° C., with a solution of 0.3×SSC and 0.1% SDS at 42° C., and with a solution of 0.1×SSC at 30° C. As used herein, the term "1×SSC" refers to an aqueous solution containing 150 mM sodium chloride and 15 mM sodium citrate (pH 7.2). Preferably, a complementary strand remains hybridized to the target plus-strand even if it is washed under such conditions. Specific examples of such complementary strand include a strand consisting of the nucleotide sequence completely complementary to the nucleotide sequence of the target plus-strand, and a strand consisting of a nucleotide sequence having at least 80% homology with the strand.

When PCR is carried out under stringent hybridization conditions using polynucleotide fragments obtained as primers from the composition or kit of the present invention, for example, a PCR buffer comprising 10 mM Tris-HCl (pH 8.3), 50 mM KCl, and 1 to 2 mM $MgCl_2$ is used, and the treatment is carried out at a temperature, Tm ±5 to 10° C., which is calculated from the primer sequence, for about 15 seconds to 1 minute. The Tm value can be calculated, for example, by the equation Tm=2×(the number of adenine residues+the number of thymine residues)+4×(the number of guanine residues+the number of cytosine residues).

Another example of the "stringent conditions" for hybridization is described in, for example, Sambrook, J. & Russel, D., Molecular Cloning, A LABORATORY MANUAL, Cold Spring Harbor Laboratory Press, Jan. 15, 2001, vol. 1: 7.42 to 7.45, vol. 2: 8.9 to 8.17, and such conditions can be employed in the present invention.

The present invention also provides a method for determining whether or not a test sample (or a specimen) from a subject contains esophageal cancer cells by measuring expression levels of the target nucleic acids or genes in the biological sample using the composition, kit, or DNA chip of the present invention, or combinations thereof and using a discriminant, i.e. the support vector machine (SVM), which is prepared using expression levels of the genes in esophageal cancer tissue and in normal tissue as training samples.

The present invention further provides a method for determining esophageal cancer comprising the following steps of:

(1) measuring in vitro expression levels of the target nucleic acids in a plurality of biological samples that are known to comprise esophageal cancer cells or be free of esophageal cancer cells using the composition, kit, or DNA chip of the present invention, or combinations thereof;

(2) preparing a discriminant (i.e., support vector machine) using the expression levels of the target nucleic acids determined in step (1) as the training samples;

(3) measuring in vitro the expression level of the target nucleic acids in a test sample from the esophagus of a subject in the same manner as in step (1); and (4) assigning the expression levels of the target nucleic acids determined in step (3) to the discriminant prepared in step (2) and determining whether or not the test sample contains esophageal cancer cells based on the results obtained from the discriminant, wherein the target nucleic acids can be detected by the polynucleotides comprised in the composition, kit, or DNA chip, mutants of the polynucleotidse, or fragments of the polynucleotides.

Alternatively, the method of the present invention can comprise, for example, the following steps (a), (b), and (c) of:

(a) measuring the expression levels of target genes in the biological samples that are known to be tissues containing and/or free of esophageal cancer cells obtained from esophageal cancer patients, using the diagnostic (detection) composition, kit, or DNA chip of the present invention;

(b) preparing a discriminant, called SVM, by assigning the expression levels determined in (a) into the following equations 1 to 5; and (c) determining whether or not the test samples comprise esophageal cancer cells on the basis of the results obtained by measuring expression levels of the target genes in the test samples obtained from subjects using the diagnostic (detection) composition, kit, or DNA chip of the present invention and then assigning the determined values to the discriminant prepared in (b).

SVM is a learning machine that was proposed in the framework of a statistical learning theory made to solve a two-class classification problem, by V. Vapnik of AT&T in 1995 (The Nature of Statistical Leaning Theory, Springer, 1995). SVM is a linear classifier but it can solve nonlinear problems in combination with the Kernel method as described below. Among many hyperplanes that classify training samples of different classes, the hyperplane that maximizes the minimum distance from the hyperplane to the training sample may be defined as the classification plane to classify a new test sample in the most accurate manner.

SVM can only solve linear problems. As a method for solving substantially nonlinear problems, a method wherein a feature vector is nonlinearly transformed into a higher-dimensional feature, and linear classification is then performed, is known. This becomes equivalent to the use of a nonlinear model in an original space. High-dimensional mapping, however, requires an enormous computational effort and reduces a generalization capability. According to SVM, the classification function depends exclusively on the inner product of the inputted patterns. If the inner product could be calculated, accordingly, the optimal classification function could be constructed. The formula that represents the inner product of two elements in a nonlinearly mapped space only by the input in original spaces is referred to as the Kernel formula. An optimal classification function, i.e. a discriminant, can be formed only by the Kernel formula without computation of features in the actually mapped space while performing high-dimensional mapping (e.g., Hideki Asou et al., *Toukei kagaku no furontia* 6 (Frontier of statistical science 6), "*Pataan ninshiki to gakushu no toukeigaku* (Statistics of pattern recognition and learning): *atarashii gainen to shuho* (new concept and procedures)," Iwanami Shoten Publishers, Tokyo, Japan, 2004).

Examples of the computation of a discriminant that can be used in the method of the present invention are shown below.

In order to determine SVM, the expression levels of the target genes in biological samples that are known to be a esophageal cancer cell-containing tissue or a normal tissue is provided as training samples, and a constant of the classification function can be determined in the following manner.

The training sample $x_i$ is assumed to belong to either a group of esophageal cancer cell-containing tissue or a group of normal tissue, and such groups are classified into (+1) or (−1). When training samples can be linearly separated by the hyperplane, the classification function is, for example, as follows:

$$f(x) = \sum_{i=1}^{n} w_i \cdot x_i + b \qquad \text{[equation 1]}$$

wherein w represents a weighting factor; b represents a bias constant; and x represents a sample variable.

This function, however, has a restriction:

$$y_i(w^T x_i + b) \geq 1 - \xi_i$$

$$\xi_i \geq 0, \, i=1, \ldots, n \qquad \text{[equation 2]}$$

wherein T represents an inner product; y represents a sample class; and ζ represents a slack variable. Thus, the Lagurange's method of undetermined multipliers may be used to regress to the following optimization problem using the Lagurange multiplier α.

$$\sum \alpha_i - \frac{1}{2} \sum \alpha_i \alpha_j y_i y_j x_i^T x_j \qquad \text{[equation 3]}$$

$$0 \le \alpha_i \le C, \sum_{i=1}^{n} \alpha_i y_i = 0 \qquad \text{[equation 4]}$$

wherein C represents a restriction parameter determined by an experiment.

If the above problem is dissolved, the following formula are consequently obtained.

$$w = \sum_{i=1}^{n} \alpha_i y_i x_i \qquad \text{[equation 5]}$$

$$b = -\frac{1}{2}(w^T x_A + w^T x_B)$$

Thus, the nonambiguous classification function can be determined. By assigning x concerning a new test sample (i.e., the gene expression level in a tissue, wherein it is not known whether or not the tissue contains esophageal cancer cells) to this function, f(x) can be classified into +1 or −1, and the test sample can be classified as the group of tissue containing esophageal cancer cells or the group of tissue containing no esophageal cancer cells.

Thus, two groups of training samples are necessary in order to prepare a SVM discriminant for classifying unknown samples. According to the present invention, such training samples are, for example, a set of samples obtained from patients of "the expressed genes $(x_1, x_2, \ldots x_i, \ldots x_n)$ obtained from a tissue containing esophageal cancer cells of an esophageal cancer patient" and a set of samples obtained from the patients of "the expressed genes $(x_1, x_2, \ldots x_i, \ldots x_n)$ obtained from cancer-free esophageal tissue cells of an esophageal cancer patient." The number (n) of the expressed genes concerning such sets varies depending on the design of the experiment. The expression levels of each gene yield significant difference, relatively small difference, or no difference between the two groups regardless of the type of experiment. In order to improve the accuracy of the SVM discriminant, distinctive differences are required between 2 groups of training samples. Thus, it is necessary to selectively extract and use genes that exhibit different expression levels between 2 groups from the set of genes.

Genes that belong to the set of genes used for the SVM discriminant are preferably extracted in the following manner. At the outset, differences in gene expression levels between the group of esophageal cancer cell-containing tissue and the group of normal tissue are determined via a t-test which is a parametric analysis, an U-test of Mann-Whitney which is a non-parametric analysis, or the like, for detecting medians of within-group expression levels, means (or average values) thereof, and difference in means. Subsequently, genes are incorporated into the set in the descending order of the differences in expression levels between two groups one by one, and the percentage of determination or identification (accuracy) is calculated every time. Gene incorporation into the gene set is repeated until the largest percentage of determination or identification is attained, and the gene set where the largest percentage of determination or identification is attained is employed.

In the method of the present invention, for example, any combination of one or more (preferably five or more) of the aforementioned polynucleotides as shown in SEQ ID NOs: 1 to 62 and/or one or more (preferably five or more) of polynucleotides as shown in SEQ ID NOs: 63 to 124 may be used. Also, the fact that the expression levels of the 62 types of target genes in esophageal cancer tissue from an esophageal cancer patient are significantly different from those in cancer-free esophageal tissue from an esophageal cancer patient (i.e., normal tissue) or the fact that such expression levels are increased or decreased in esophageal cancer tissue obtained from an esophageal cancer patient are used as indicators to determine the expression levels of the 62 types of genes. Thus, the esophageal cancer can be identified with an accuracy (or probability) of preferably 80% or higher, more preferably 85% or higher, further preferably 90% or higher, still further preferably 92% or higher, and most preferably 95% or higher (FIG. 1).

The present invention further provides a method for detecting esophageal cancer comprising measuring in vitro the expression levels of the polypeptides in esophageal cancer tissue obtained from an esophageal cancer patient and in cancer-free esophageal tissue obtained from an esophageal cancer patient, or the blood levels (or existing amounts), of the polypeptides by using one or more (preferably five or more) antibodies against respective polypeptides encoded by the aforementioned 62 types of genes (e.g., represented by SEQ ID NOs: 1 to 62) or fragments thereof (e.g., represented by SEQ ID NOs: 63 to 124), such as polypeptides consisting of the amino acid sequence as shown in any of SEQ ID NOs: 125 to 186 or fragments thereof.

The above-mentioned antibodies or fragments thereof includes, for example, polyclonal antibodies, monoclonal antibodies, synthetic antibodies, recombinant antibodies, polyspecific antibodies (including bispecific antibodies), single chain antibodies, Fab fragments, and F(ab')$_2$ fragments. The polyclonal antibody can be prepared as a specific antibody by a so-called absorption method, which comprises binding the antibody to an affinity column to which a purified polypeptide has been bound.

The measurement can comprise the steps of: bringing an antibody labeled with a conventional enzyme or fluorophore or a fragment thereof into contact with a tissue section or homogenized tissue; and qualitatively or quantitatively measuring an antigen-antibody complex. Detection is carried out by, for example, a method wherein the presence and the amount of a target polypeptide are measured by immunoelectron microscopy or a method wherein the amount of a target polypeptide is assayed by a conventional method, such as ELISA or a fluorescent antibody method. When the expression levels of the target polypeptides or the amounts of such polypeptides in the blood are increased or decreased in the esophageal cancer tissue obtained from an esophageal cancer patient compared with the cancer-free esophageal tissue obtained from an esophageal cancer patient, the subject is determined to have esophageal cancer. In other words, when the expression levels or amounts of the existing target polypeptides are increased or decreased in comparison with those of non-esophageal cancer cells obtained from an esophageal cancer patient, the subject is determined to have esophageal cancer. When such levels are increased or decreased, a statistically significant difference may exist (p value of ≤0.05).

The present invention is described in greater detail with reference to the examples set forth below, although the technical scope of the present invention is not limited thereto.

EXAMPLES

1. Clinical and Pathological Findings Concerning Subjects

Informed consents were obtained from 57 patients with esophageal cancer, and the esophagus tissues were excised from the patients at the time of surgical excision of esophageal cancer or esophageal biopsy. Part of the excised tissue was visually and/or histopathologically inspected to identify the esophageal cancer tissue, the esophageal cancer lesions were separated from the normal tissue, and those tissues were immediately frozen and stored in liquid nitrogen.

2. Extraction of Total RNA and Preparation of cDNA

The esophageal cancer lesion tissues or esophageal non-lesion tissues of the esophageal tissue obtained from an esophageal cancer patient were used as samples. Total RNAs were prepared from the tissues using a Trizol reagent (Invitrogen) in accordance with the manufacturer's recommended protocols.

The thus-obtained total RNA (1 µg) was subjected to reverse transcription using oligo (dT) primers in combination with random nonamers and using the CyScribe First-Strand cDNA Labeling Kit (GE Healthcare) in accordance with the manufacturer's recommended protocols. Cy3-dUTP (GE Healthcare) was added to total RNA obtained from the esophageal cancer tissue, Cy5-dUTP (GE Healthcare) was added to Human Universal Reference RNA (Stratagene), and cDNA was labeled at the time of reverse transcription in accordance with the manufacturer's recommended protocols. The labeled cDNA was purified using the QIA quick PCR purification Kit (QIAGEN) and then subjected to hybridization.

3. Preparation of DNA Chip

Genes were identified using the 3D-Gene human whole gene type DNA chip, developed by Toray Industries, Inc. The DNA chip was operated in accordance with the protocols instructed by Toray Industries, Inc. As a result of the analysis using the DNA chip, a total of 1,119 types of genes, i.e., the genes whose expression patterns may vary due to esophageal cancer, were extracted without overlaps.

Sequences consisting of 60-70 residues at sites having high sequence specificity of the extracted 1,119 types of genes were selected and synthesized while avoiding sequence overlapping. Custom chips were prepared using the 3D-Gene substrate with 1,296 columns (Toray Industries, Inc.).

4. Hybridization

The labeled cDNAs (1 µg each) were fractionated, dissolved in hybridization buffer (Toray Industries, Inc., Japan), and subjected to hybridization at 42° C. for 16 hours. After hybridization, the DNA chip was washed successively with a solution containing 3×SSC and 0.1% SDS at 30° C., a solution containing 0.3×SSC and 0.1% SDS at 42° C., and a solution containing 0.1×SSC at 30° C.

5. Measurement of Gene Expression Level

The DNA chip that had been subjected to hybridization in the above-described manner was scanned using the DNA array scanner (ScanArray Lite, Perkin Elmer Japan) to obtain an image, and the fluorescent intensity was expressed numerically using the GenePix Pro5.0 (Molecular Device). The statistic procedures were carried out with reference to Speed, T., "Statistical Analysis of Gene Expression Microarray Data," Chapman & Hall/CRC, and Causton, H. C. et al., "A Beginner's Guide: Microarray Gene Expression Data Analysis," Blackwell publishing. Specifically, the data obtained by the image analysis following hybridization were converted into log values, which were then normalized by global normalization. Consequently, the genes whose expression levels in the esophageal cancer lesion tissues were decreased (or lower) or increased (or higher) than those in the esophageal cancer non-lesion tissues, were found. These genes are considered to be usable as genes for detecting esophageal cancer.

6. Prediction Scoring System

Specimens obtained from 57 patients were used as training samples to prepare an SVM discriminant loaded on the Genomic Profiler (Mitsui Knowledge Industry, Japan). All the normalized data concerning the 57 cases were subjected to prediction using this discriminant. A linear Kernel was employed as Kernel. Genes were determined in the descending order of a difference in medians of within-group expression levels between the two groups (i.e., a group of the esophageal cancer lesion tissue and a group of esophageal cancer non-lesion tissue). (Table 1: Comparison of expression levels of gene transcripts in esophageal cancer tissue obtained from esophageal cancer patient with those in cancer-free esophageal tissue (normal tissue) obtained from esophageal cancer patient)

TABLE 1

| SEQ ID NO: | Gene name | Ref Seq ID | Normal | Tumor | Proportion | Order of genes used for identification |
|---|---|---|---|---|---|---|
| 1 | EYA2 | AL049540 | 0.45 | 0.87 | 1.94 | 3 |
| 2 | SERF1A | AF073519 | 0.44 | 0.81 | 1.83 | 4 |
| 3 | IGHG1 | NM_000014 | 0.95 | 1.42 | 1.49 | 5 |
| 4 | ITSN2 | NM_019595 | 0.81 | 1.02 | 1.26 | 9 |
| 5 | RAB11FIP5 | BC035013 | 0.85 | 1.06 | 1.25 | 10 |
| 6 | HSPA1A | NM_005345 | 0.81 | 1.01 | 1.25 | 11 |
| 7 | NMU | NM_006688 | 0.79 | 0.96 | 1.21 | 13 |
| 8 | E2F3 | NM_001949 | 0.79 | 0.93 | 1.19 | 15 |
| 9 | ESR2 | NM_001437 | 0.91 | 1.08 | 1.18 | 16 |
| 10 | CFDP1 | NM_006324 | 0.88 | 1.04 | 1.18 | 17 |
| 11 | HSPC190 | NM_016459 | 0.80 | 0.94 | 1.18 | 18 |
| 12 | COL1A2 | Z74616 | 1.10 | 1.29 | 1.17 | 19 |
| 13 | GCS1 | NM_006302 | 0.90 | 1.06 | 1.17 | 20 |
| 14 | PARL | NM_018622 | 1.30 | 1.12 | 0.86 | 23 |
| 15 | CELSR2 | NM_001408 | 0.63 | 0.72 | 1.14 | 25 |
| 16 | NDRG1 | NM_006096 | 1.02 | 1.17 | 1.14 | 26 |
| 17 | SLC25A44 | NM_014655 | 0.61 | 0.53 | 0.88 | 27 |
| 18 | TUSC2 | NM_007275 | 0.91 | 1.03 | 1.13 | 28 |
| 19 | SLC4A1 | NM_000342 | 0.95 | 1.08 | 1.13 | 30 |
| 20 | MS4A7 | NM_206938 | 0.72 | 0.64 | 0.89 | 33 |
| 21 | TMSB4X | M17733 | 0.68 | 0.77 | 1.13 | 34 |
| 22 | PRC1 | NM_003981 | 1.23 | 1.09 | 0.89 | 36 |
| 23 | VCP | NM_007126 | 0.83 | 0.92 | 1.11 | 38 |
| 24 | RBM9 | NM_014309 | 0.97 | 1.07 | 1.11 | 39 |

TABLE 1-continued

| SEQ ID NO: | Gene name | Ref Seq ID | Normal | Tumor | Proportion | Order of genes used for identification |
|---|---|---|---|---|---|---|
| 25 | GPR126 | BC075798 | 0.83 | 0.92 | 1.11 | 41 |
| 26 | HOXA10 | BC013971 | 0.77 | 0.85 | 1.11 | 43 |
| 27 | PPP1R1A | NM_006741 | 1.07 | 1.18 | 1.10 | 44 |
| 28 | MYO9B | NM_004145 | 0.52 | 0.57 | 1.10 | 45 |
| 29 | SLCO4C1 | NM_180991 | 1.06 | 1.17 | 1.10 | 47 |
| 30 | SERPINB13 | NM_012397 | 0.73 | 0.80 | 1.09 | 51 |
| 31 | SDC2 | J04621 | 1.24 | 1.14 | 0.92 | 53 |
| 32 | TOR1A | NM_000113 | 1.09 | 1.19 | 1.09 | 54 |
| 33 | RPL18A | NM_000980 | 0.70 | 0.76 | 1.09 | 55 |
| 34 | GAS7 | NM_201432 | 0.83 | 0.91 | 1.09 | 56 |
| 35 | WISP1 | NM_003882 | 1.40 | 1.29 | 0.92 | 57 |
| 36 | CACNG4 | NM_014405 | 0.82 | 0.89 | 1.08 | 58 |
| 37 | S100P | NM_005980 | 0.69 | 0.75 | 1.08 | 61 |
| 38 | UCHL5 | NM_015984 | 1.37 | 1.27 | 0.93 | 62 |
| 39 | AQP3 | NM_004925 | 1.31 | 1.12 | 0.86 | 21 |
| 40 | NSUN5 | NM_018044 | 0.73 | 0.83 | 1.13 | 29 |
| 41 | B4GALT2 | BC096821 | 0.89 | 1.00 | 1.13 | 32 |
| 42 | CD48 | NM_001778 | 1.25 | 1.12 | 0.90 | 37 |
| 43 | DAB2 | NM_001343 | 0.88 | 0.80 | 0.90 | 40 |
| 44 | EBI3 | NM_005755 | 1.35 | 1.22 | 0.90 | 42 |
| 45 | MAP3K12 | NM_006301 | 0.75 | 0.83 | 1.10 | 46 |
| 46 | SPEN | NM_015001 | 1.26 | 1.15 | 0.91 | 50 |
| 47 | ARHGEF3 | NM_019555 | 1.01 | 0.93 | 0.92 | 59 |
| 48 | COL3A1 | X06700 | 1.16 | 1.27 | 1.09 | 52 |
| 49 | CSTB | NM_000100 | 3.18 | 1.26 | 0.40 | 2 |
| 50 | SPRR3 | NM_005416 | 6.49 | 1.37 | 0.21 | 1 |
| 51 | SLIT2 | NM_004787 | 1.45 | 1.03 | 0.71 | 6 |
| 52 | CAMK2B | NM_001220 | 1.47 | 1.13 | 0.77 | 7 |
| 53 | SLC2A14 | NM_153449 | 1.19 | 0.92 | 0.77 | 8 |
| 54 | SATB2 | NM_015265 | 1.40 | 1.13 | 0.81 | 12 |
| 55 | SEPT6 | NM_015129 | 1.49 | 1.24 | 0.83 | 14 |
| 56 | GALNS | NM_000512 | 1.26 | 1.09 | 0.86 | 22 |
| 57 | TROAP | NM_005480 | 1.23 | 1.07 | 0.87 | 24 |
| 58 | XRCC3 | NM_005432 | 1.11 | 0.98 | 0.89 | 31 |
| 59 | FGF3 | NM_005247 | 1.29 | 1.15 | 0.89 | 35 |
| 60 | EIF4EBP2 | NM_004096 | 1.16 | 1.05 | 0.91 | 48 |
| 61 | RRM1 | NM_001033 | 1.18 | 1.29 | 1.10 | 49 |
| 62 | M6PR | NM_002355 | 0.94 | 1.02 | 1.08 | 60 |

Sixty two types of genes as shown in column 7 (i.e., the seventh column from the left) of Table 1 were selected in descending order from the highest ranked gene, and an SVM discriminating machine for identifying the esophageal cancer tissue was prepared. Column 7 shows the descending order of the absolute values of the differences between a median of the expression levels of the gene in esophageal cancer tissue (column 5) and a median of the expression levels of the gene in normal tissue (column 4). In determining the number of genes to be used for the discriminating machine, genes were selected in accordance with the order shown in column 7. The discriminating machine was prepared using 56 out of 57 sets of esophageal cancer lesion tissues and esophageal cancer non-lesion tissues while excluding 1 set, and the accuracy of the discriminating machine was evaluated with the use of such 1 excluded set of tissues. The results of gene expression analysis carried out with the use of polynucleotides as shown in SEQ ID NOs: 63 to 124 as probes in combination were examined. As a result, a machine was obtained that was capable of differentiating between an esophageal cancer lesion tissue and an esophageal cancer non-lesion tissue with an accuracy (or probability) of 86.0% or higher with the use of 5 types of polynucleotides as shown in SEQ ID NOs: 63 to 65, 111, and 112 in combination, with an accuracy of 87.7% or higher with the use of 10 types of polynucleotides as shown in SEQ ID NOs: 63 to 67 and 111 to 115 in combination, with an accuracy of 91.2% or higher with the use of 16 types of polynucleotides as shown in SEQ ID NOs: 63 to 71 and 111 to 117 in combination, with an accuracy of 93.0% or higher with the use of 20 types of polynucleotides as shown in SEQ ID NOs: 63 to 75 and 111 to 117 in combination, and with an accuracy of 96% or higher with the use of 62 types of polynucleotides as shown in SEQ ID NOs: 63 to 124 in combination (FIG. 1). When gene expression was analyzed with the use of the polynucleotide as shown in SEQ ID NO: 112 alone as a probe, the probability of differentiating between the esophageal cancer lesion tissue and the esophageal cancer non-lesion tissue was 42.1%.

Figure 2:
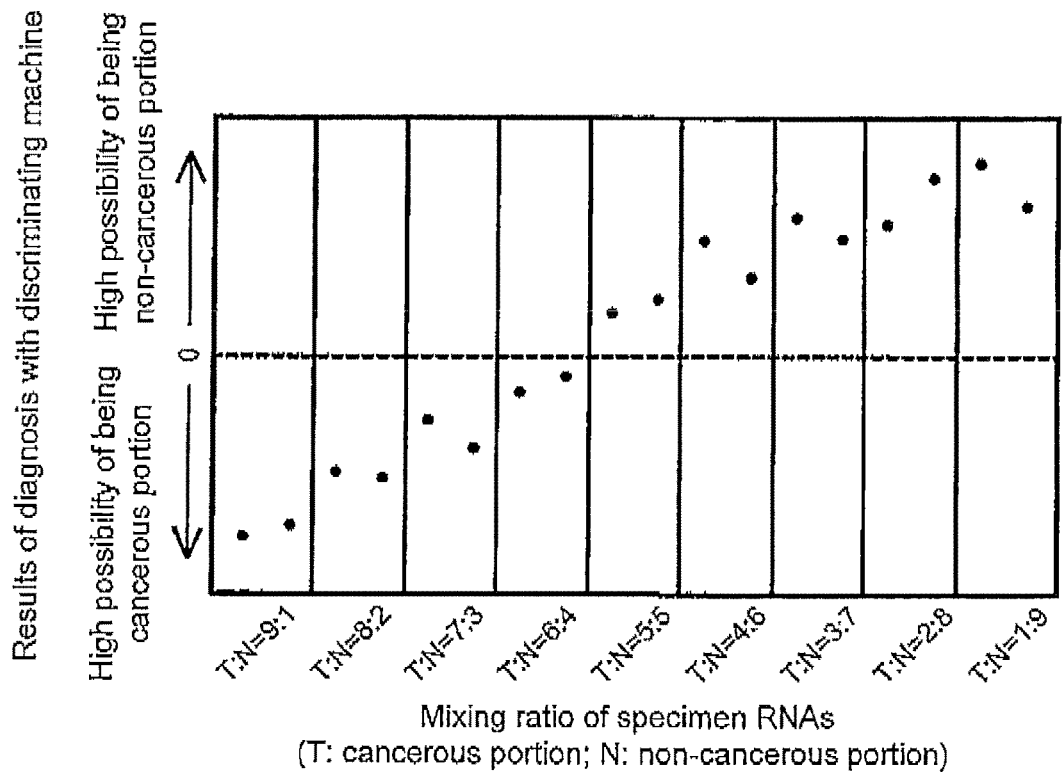
FIG. 2 shows the detection rate of the presence of esophageal cancer cells by using any combination of the polynucleotides as shown in SEQ ID NOs: 63 to 124 which correspond to the genes described in Table 1. The vertical axis shows the probability representing the existing rate of esophageal cancer tissues in specimens; and the horizontal axis shows, from left to right, the data obtained from RNA cocktails prepared by mixing total RNA obtained from the esophageal cancer tissue and total RNA obtained from cancer-free esophageal tissue at ratios of 9:1, 8:2, 7:3, 6:4, 5:5, 4:6, 3:7, 2:8, and 1:9.

In order to determine the percentage of cancer-free esophageal tissue contained in the tissue obtained from an esophageal cancer patient, which could be identified by the prepared discriminating machine, subsequently, total RNA samples obtained from the esophageal cancer tissue were mixed with total RNA samples obtained from the cancer-free esophageal tissue at ratios of 9:1, 8:2, 7:3, 6:4, 5:5, 4:6, 3:7, 2:8, and 1:9, and the resulting RNA cocktails were used for cDNA preparation, hybridization, and measurement of gene expression levels to obtain the data. These pieces of data were subjected to prediction with the use of the discriminating machine used for preparing the data of the specimens obtained from 55 patients. As a result, the discriminating machine was found to be capable of identifying the data as a cancer lesion, when over 60% of the tissue contained esophageal cancer (FIG. 2).

Figure 3:
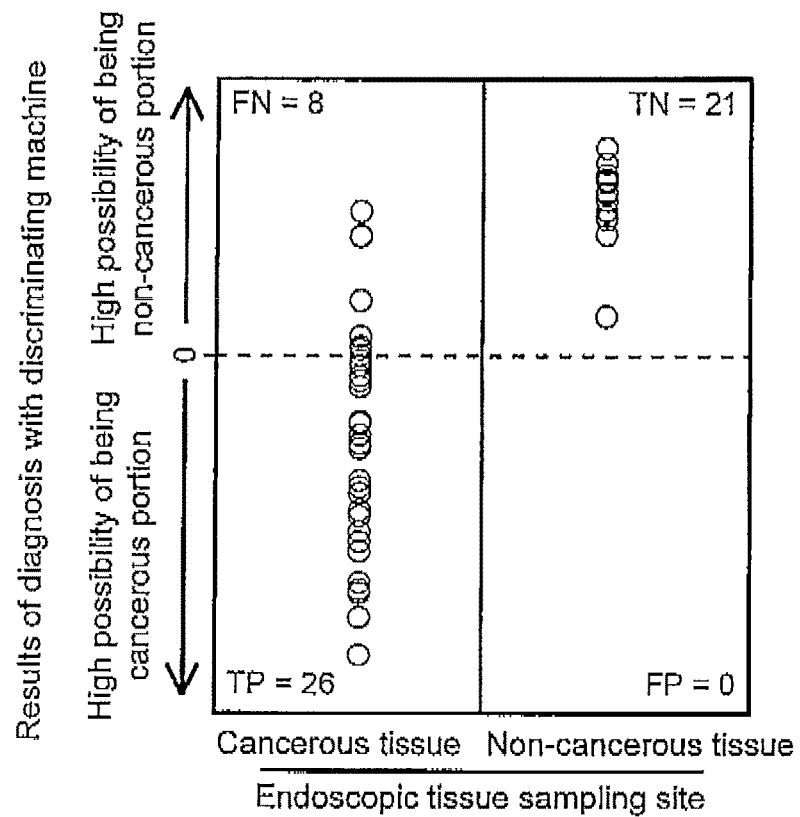
FIG. 3 shows the detection rate of the presence of esophageal cancer cells obtained from biopsy tissues by using any combination of the polynucleotides shown in SEQ ID NOs: 63 to 124 which correspond to the genes shown in Table 1. The vertical axis shows the probability representing the existing rate of esophageal cancer tissues in specimens; and the horizontal axis shows the data obtained from biopsy cancer-free esophageal tissues of esophageal cancer patients obtained using an endoscope (i.e., the data shown in the left frame) and the data obtained from biopsy samples containing esophageal cancer of esophageal cancer patients obtained using the endoscope (i.e., the data shown in the right frame).

In order to inspect an general accuracy of the prepared discriminating machine, further, esophageal biopsy tissues were obtained from 55 esophageal cancer patients, from whome informed consents had been obtained, at the time of esophageal biopsy, and extraction of total RNA, preparation of cDNA, hybridization, and measurement of gene expression levels were performed in the same manner to obtain the data. These data were subjected to prediction with the use of the discriminating machine used for preparing the data of the specimens obtained from 55 patients. As a result, the esophageal cancer tissues obtained from esophageal cancer patients were found to be differentiated from the cancer-free esophageal tissue obtained from an esophageal cancer patient with the accuracy probability of 85.5%. In this case, the probability of identifying the cancer-free esophageal tissues obtained from esophageal cancer patients was 100% (FIG. 3).

Comparative Example 1

Figure 4:
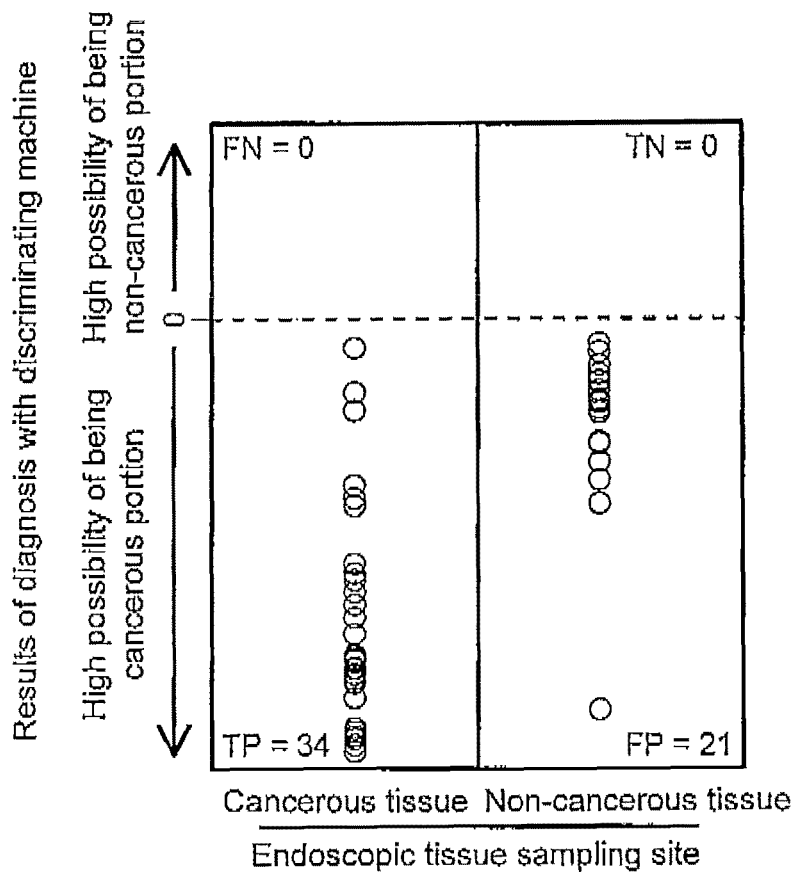
FIG. 4 shows the detection rate of the presence of esophageal cancer cells by using any combination of the polynucleotides which correspond to the composition for diagnosis of esophageal cancer described in WO 2006/118308. A discriminating machine to identify the cancer was prepared in accordance with the method of WO 2006/118308, and the existing rates of esophageal cancer tissues in byopsy samples were determined. The vertical axis shows the probability representing the existing rate of esophageal cancer tissues in byopsy samples, and the horizontal axis shows the data obtained from biopsy cancer-free esophageal tissues of esophageal cancer patients obtained using an endoscope (i.e., the data shown in the left frame) and the data obtained from biopsy tissues containing esophageal cancer of esophageal cancer patients obtained using the endoscope (i.e., the data shown in the right frame).
Figure 5:
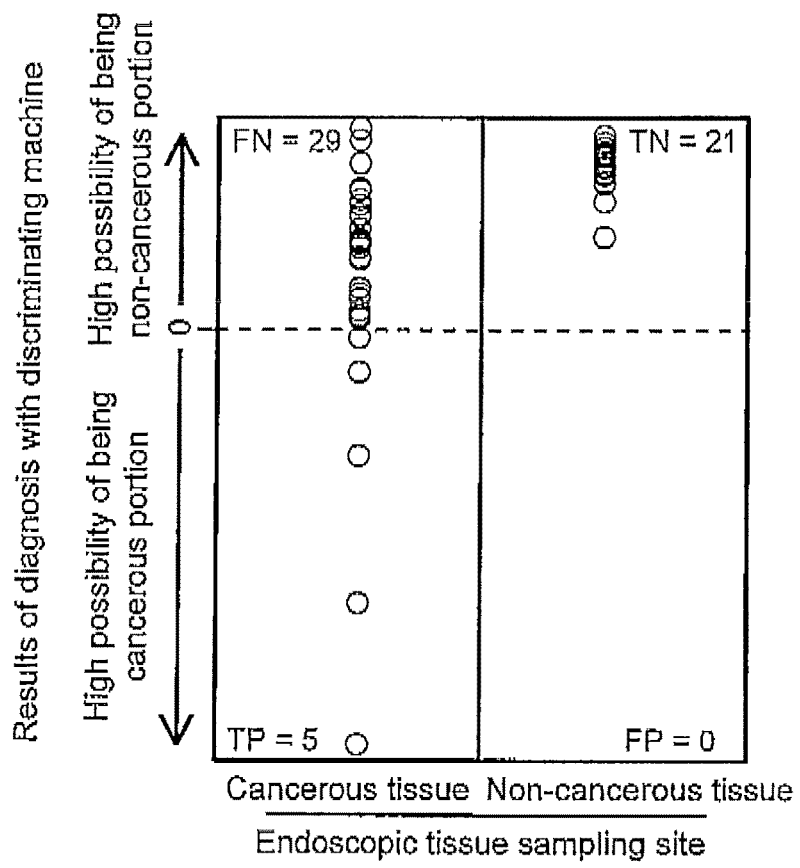
FIG. 5 shows the detection rate of the presence of esophageal cancer cells by using any combination of the polynucleotides which correspond to the composition for diagnosis of esophageal cancer described in WO 2006/118308. A discriminating machine to identify non-cancer was prepared in accordance with the method of WO 2006/118308, and the existing rates of esophageal cancer tissues in byopsy samples were determined. The vertical axis shows the probability representing the existing rate of esophageal cancer tissues in byopsy samples; and the horizontal axis shows the data obtained from biopsy cancer-free esophageal tissues of esophageal cancer patients obtained using an endoscope (i.e., the data shown in the left frame) and the data obtained from biopsy tissues containing esophageal cancer of esophageal cancer patients obtained using the endoscope (i.e., the data shown in the right frame).

In order to compare the general accuracy of the composition for diagnosis of esophageal cancer of the present invention and the genaral accuracy of the composition for diagnosis of esophageal cancer according to WO 2006/118308, esophageal biopsy tissues were obtained from 55 esophageal cancer patients, from whom informed consents had been obtained, at the time of esophageal biopsy, and extraction of total RNA, preparation of cDNA, hybridization, and measurement of gene expression levels were performed in the manner described herein to obtain the data. These data were subjected to prediction with the use of the discriminating machine, and the composition for diagnosis of esophageal cancer according to WO 2006/118308 was subjected to prediction with the use of the discriminating machine by the method according to WO 2006/118308. As a result, the discriminating machine for identifying cancer was found to differentiate the esophageal cancer tissues obtained from esophageal cancer patients and the cancer-free esophageal tissues obtained from esophageal cancer patients with the accuracy probability of 61.8% (FIG. 4), and the discriminating machine for identifying a non-cancer was found to differentiate the esophageal cancer tissues obtained from esophageal cancer patients from the cancer-free esophageal tissues obtained from esophageal cancer patients with the accuracy probability of 47.3% (FIG. 5). The obtained results indicate a lower probability of identifying the cancer-free esophageal tissues obtained from esophageal cancer patients using the discriminating machine prepared with the use of the composition for diagnosis of esophageal cancer of the present invention and the method of the present invention. The results also demonstrate that the composition for diagnosis of esophageal cancer and the technique according to WO 2006/118308 produce high accuracy regarding the surgical specimens, although such composition and method are not sufficient for biopsy samples. This demonstrates that the composition for diagnosis of esophageal cancer and the method of the present invention were superior to those of the conventional technique.

Comparative Example 2

Figure 6:
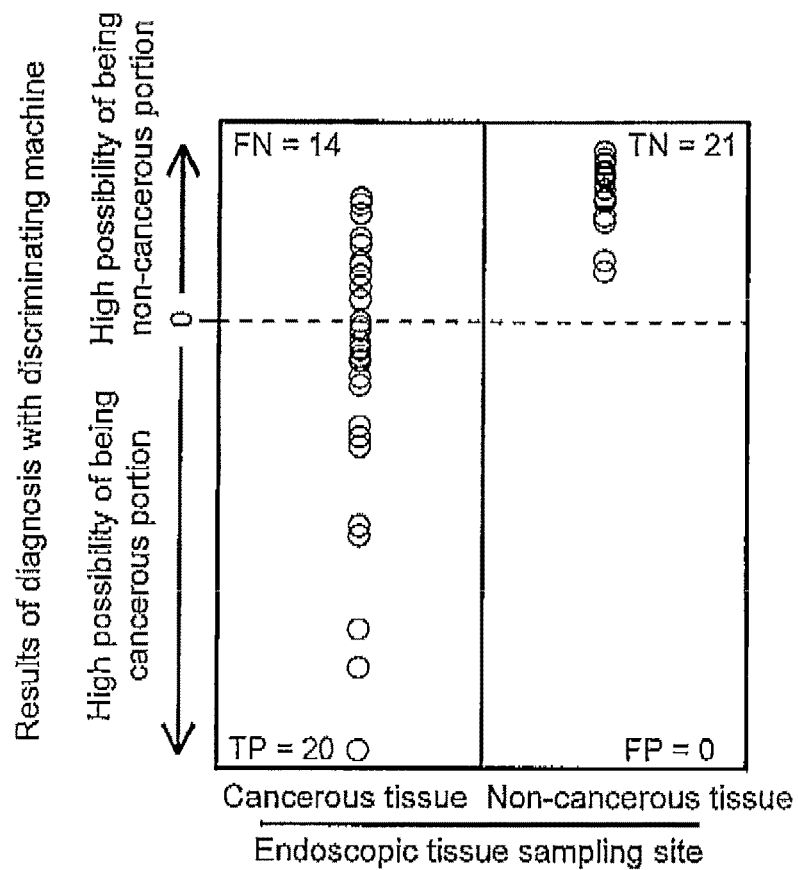
FIG. 6 shows the detection rate of the presence of esophageal cancer cells by using any combination of the polynucleotides which correspond to the composition for diagnosis of esophageal cancer described in WO 2006/118308. A discriminating machine was prepared in accordance with the method as described herein, and the existing rates of esophageal cancer tissues in byopsy samples were determined. The vertical axis shows the probablity representing the existing rate of esophageal cancer tissues in byopsy samples; and the horizontal axis shows the data obtained from biopsy cancer-free esophageal tissues of esophageal cancer patients obtained using an endoscope (i.e., the data shown in the left frame) and the data obtained from biopsy tissues containing esophageal cancer of esophageal cancer patients obtained using the endoscope (i.e., the data shown in the right frame).

The composition for diagnosis of esophageal cancer according to WO 2006/118308 was subjected to prediction with the use of the discriminating machine by the method of the present invention. As a result, the esophageal cancer tissues obtained from esophageal cancer patients were differentiated from the cancer-free esophageal tissues obtained from esophageal cancer patients with the accuracy probability of 74.5% (FIG. 6). Such accuracy was lower than that of the discriminating machine prepared from the composition for diagnosis of esophageal cancer of the present invention. The results also demonstrate that the composition for diagnosis of esophageal cancer and the technique according to WO 2006/118308 produce high accuracy regarding the surgical specimens, although such composition and method are not sufficient for biopsy samples. This demonstrates that the composition for diagnosis of esophageal cancer and the method of the present invention were superior to those of the conventional technique.

Industrial Applicability

The present invention can provide a composition for identifying esophageal cancer with high specificity and sensitivity, and such composition is very useful at least for determining the percentage of esophageal cancer tissue contained in the tissue obtained from an esophageal cancer patient at the time of surgery or endoscopy.

All publications, patents, and patent applications cited herein are incorporated herein by reference in their entirety.

SEQUENCE LISTING (186 sequences)

SEQ ID NO: 1 - DNA, 31737 bp, Homo sapiens
gatctgacttagggttgaacaggatccctctggctgctggctggagactaggctgggaggataggggctagataaggataggagcaggaagagtgaggaggtgactgtagtagcctacaccaggggtcaacaaacttctgtaaaggaccagagagtaaatatttttggctttgcacatcatagtggacctgtctcagctactcagttctcctgcagtagcacaaaagctgcagcagacaggatgtaattgcatgaacatagatgtgttctaataaaactttatttacacaaacaggcgacaggccagatttggcccctgggttatagcttactaacctctgatctaggtgggagatgatggtggtttggaccacggtggggcggggggcggtgcgggcagtggaggaggtgagaatggtcagattgtgggtatatgtcgaagggaaagccaacaggatttggtgatggatgggtggcaggatgtcagagagaggagacggggataactccaagacacatgcagtgcctaggccagtgttgggaacatagaaggtgatcagtgtgtacgcatcttgaatcagcaatttggtatttcatgcctctttgccttgtcttttccagtgacatgataggcactgtgagggcaagagccagatttcatccttgaagcctcccctctctttttttttttcaagcttaattcactttatttttcttgtataaaaaccctacgttgtagccacagctggagcctgagtcctctgcacagagactctgatggggtcttgacaaggtagtcagtgaattcctgacctgaattcctgaattctagggagacttggtgaatacagtctccttccagaggttgggggtcgggtagctgtaggtcttagagatagcatcaaaggtggccttggtgaagtttcccagggtggcagtgcagctgcggcgtagcagtcatagatacccgccatcagcagcagcttttgggcatggggactgagacgatgccagtgcccctgggtgcagggatgaagtgcaccagcacagagccacagtggcctgtcaccttacaagggacggtgtggggcttgccgatcttgctcccccagtagcctctgcacatggggacaatggagagctagcccaggatgatggccccgcggatggcgtggccacctccttggagcacttaacacccagaccgacataccattatagtcaccgatgacaataaatcccttgagcctggtgcgctggctggcgtgggtctgcttttgtactggcatgatcttcaaaacctcatccttgagagaagcccccaggaaaaagtcaatgatctcaaactctttgatggccaggaagaagagatagatctcctccaggaacttgatcttcatgtccttgaccaggtggcccagcttggggatagacgtccactccttgtccttggtcttgcctctgtgagctcctcggccttggcccgggccctgtccgcggctatgaccccagccccggatgcccctgctgaagcctccacggaagccaccgtggttccccatcccagggtccccagggcctccagccccccatcccccaaaaccggatgttttcttggagaagaaagaagcttcccctctcttgacccatcaatgtctgatgcggtgccgggcccatagtaggtgtttttatagtcttgggatagacagatcttctcgagcacaggctctgaaaggagatgggtccgggtgctggctcctcttcccctcgccttgggcacatctgagtttgcttgagctgccattacaaagtcccacagactgggtgccttaaacaagagaaacttactgtcccacagttcatgagacgagaagtccaagatcaaggttggttccttctgagggctgcaagggagaatcttttccttgcctttctcctagctcctggtggtctcggatgtcctctgactcgtagagaacatgtcacccggtctctgtcctcgtcatcacctggcattcttcgtcttctgtctctgtgtccaaataccccctttataaggacacagacatattggatgaaggcccacgctaaggtcctcatcttaatgtgatcatctgcaaagaccctatttccaaataaggtcacattcaacatcttgtaggggacacagttcaacccataacaggcatgttcctacactcctctctgcctcgttttctcctagtttcccactacatatatagaaagtgctggccatagtccctggcacattgaaagcttttaataaatactagtttctatccctagtccaatactagtttctgtccagtgatagagatttttgtctctatctcactgagatatttgtaattaatttttttcaaaagcagtacatacacacattatcctttttttttttttttttttgagacacagtctcgccctgtcacccaggctgaagtacagtggtgcgatcataactcactccagcctcgacctccccaggcttaggtgatcctcccacctcagcctcccaagtagctacaactgtaggtacatgtcgctacacctggctaatttttgtatttttggtagaaacagagtctcaccatgttgtccaggctggtctcaaactcttgggctcaggagatgcaccctctttggcctcccaaagtgttaggattataggtgtgagccaccacacctggccctcattttttttaatgaaagtatttcaataagctaaaaccttctttgatcaccagcccaatcccagtgactccccatatgaaactgctgcttccagccagatgtatgggcttccagatctttctttttccagttatgtacaatatatccatataaaaatctcatattttaatgggattttataaatatatacatggcatcatactgggtgtatcactcttttttttttttaaacagagtcttgctctgtcacccaggctggagtgcagtggcgccatctcagctcactgtaacctccacctcctgggctcaagcgatcctcctttctcagcctcccaagtagctgggattacaggtgtatgccaccatgcctggctaactttttgtatttttaatagagacagggtttcactatgttggccaggctggtctccaactcctgacctcaagctatctgcccaccttggcctcccaaagtgctgggattacagatgtaagccaccgcgcccagccggatgtatgattctttaacctgcgtttttcacactccaggatgtcttggaaccatttccatgtgctagcataaaaattcacctccttggcttgggacgtggctcacgcctgtaatccccgcactttgggagtccgaggcaggggggtcatctgaggtcgggagttcaagaccggcctgaccaagatggagaaaccccgtctctactaaaaatacaaaattagccaggcgtggtggtgcatgcctgtaatcccagctactcagaaggctgaggcaggagaattgcttgaacctgggaggaagaggttgcagtgagccgagactgcaccattacactccagcctgggcaacaagagcaaaacactgtctcaaaaaaaaaaaaaaaaaaaaaatccacctcctttttctgcactgctgggtaggattccactgaatggatataccacattttatttagctacgacctcatcaagggaactttaggtgttttccagtttctcaccaggatgatggacatttttacacaaggctctttgcaggtgttactctgggtcagaaagtaaaaatccctcgagacggggattgcaccaggtcccggtcctcagccccactgcacttcacctgtgtcaaggccacgggaacccttccaccgtctctgccagcagatgccattcagcacccaccccaagatactcatactttgacccggaagagaccagaagcaccctgcagttcgtgtggacaagtctcccctctgacttacagtcccctcaccctcgtacctaggagagggatggcagcgctgagggtcgtgggattctcttccctggaggctcccccatcctcgtggcctctgcgcggtccagctcccctccgagctggctcaaggggtaacttgatccaggtcagctggtggagtatgaggtagcgtctagctgagcgtcacggtattttattaagtccgaaatgtgatcgctactgttgtcacactttagcgcccccaacaatccccttacaaatgagaaaaacagagcctccccaaatgcctttcctctgacatcaaggaaagcgcatggaaccctgcccagaggcctgagcccgggtgaccccaggagtggctccagagcttgaggaaaggcctggggggcggagggggtgtttttccagtttcaggcaaagcagtgagctgggggctatctgctgtttcctctgcgcctgggtctgtaaagtcagcggttgccgtttaaatcccattttccttaacatgtcaggattgctcattctaggccatccatttatatggccatggctcagaggtctcagactcacatgcctagtggggtcaaggatccaggtaacgtaaactgaagcaagccccgtagagatggtgggaaactgtaaatggatgccctggctgaaggaggtagctgaaaatctggagagagaacaagaacaagaagagaaagggaagaggaggcagagagaaaagagagaggacatcccccaagtttacatattgcccattgcttcaaaaaaatttaaacatgcaatgagctaagtaggtatgtctccaggccagtttgcaggctcttccctaactgaacttatcaacacagtagacaagctgccggcctggctccctcacccctctagagcagcactgtccagtagagatttctgcgatgataaaatatctgcagcgttcactgcaataaccactggctacatgtagctcttgagcacttgaagtaggactaaagaactgaacctttaatgttatttaactttactgaatttcaatataactataactagccacaggcaactaattgctaccatattagacaacatggctctagattctttcaatgtggagggtatcatcgtgcttgactactgcaaaaaagatcactccttcttggggagagggggtagattatacctgagaccaccaagcattaatcagagtcctgggtaaatggaaagaaaggaaattcgaaatactgagcagtaaaagcttaggtgtaaccagatgtctgctggctcaagagtggtcactcagtgtccttccactcccccacttcccagtgagtttctcattcagggtcaccctttagcatccactgtgttcttggccatctgcttactcccatttgcccagagctgacccctaggaagccacctgggggaacttccctgctgccgttggtctccaggccttaagagcacaccactgtccaaacccagggtgctgcccgtgggtcacagaggtgcaaggtcctatgcagaggcgagaacggcagttgcactttgtcacctgccacaaagttgctgtgcctgggcccatgtgtgtcaaggactctggaaacaagcctcacctttcatcaaaaccctttctaatctgaggcccattcaaggggccggagagggaccagcagccgcactacccccttgccaacccctctctcagattccagcccagctccccacagggcaacccaggctgccccagatgccactgacccctctcttgcctccctaaacatcaccataacaacaagactaccttatgtatcttttaaaaattaatgaggaggcctgtaattctaccactttgggaggccacagcgggaggatcacttgagcccagaagttcaagaccagcctgggcaacatattgagaccctatctctatttttcaaaaaaagaaaaaaaatgaatgaggtaggggcttcccaccatccccctgcaaagcttatattctcaaagataaattcaagccttttggccaggcacggtggctcatgcctgcaatcttagcacttcgggaggccaagactagaggatctcttgaggccaggagtttgagaccagcctggccaacatagcaaaacctcatctctactcaaaatacaaaaattagctaggcatggtggcacacacctgtagtcccaactacttgagaggctgaggcttgagaatcacctaaacctgggaggtggtggcagtgaactgagattgtgccactgcactccagcttgggtgacagagcaagactgtcttaaaaaaaaaaaaaaaaaaaaaaaaaaaaaaaaaaaaaaaaaagctttttgcttgtccaattgtctaaaaagagatctgttcaaaatgttgcaaataccctttcttccaatttctctactcccatcaaggttccagagatgttacaaccaattttttctcagtagtcaagctcagagtcccacgtgcttctcctcctccagcagcctttgtaaggaggcagctgcctcgagaaatcaccttgcaactaaactgtgggaaaatgtgtaagatcttaacacagtggtagaaactaacatgtatgcagtagccactgtgcacccgacactgttctcggtgctctcatgcagcatctcgcttctcctcacctcatctggaggtgggttcagttatcaggtccatttatcagtcaggcctctggggttcatgagggtcatgcccctcactcaaggtcacacactgggaagcggttggatccaggatccaggcccaggcagtcagattccagagcctgcaccctgaaccagtaccgcaggggctggcacccccgcacattttttgccccatcaacatattatcatgtcactccgccagcatcatgaagtgcactcatgatatgtttgccccatcagcgtgtcacgagggcatttcatgatgcaggcggggttggcaggtgtgcatcgtgtaggctccacatgggacatggcatcccttatgactcttggctgcaaagtgccagaaacccagctccactcacttaatctgaaaagtgggtgtatttgttcgccagggctgctgtaacaaatttcccccagttactggcttcaaacaacacacacgtgtcctcttacagttctggaggtcaggctctgagaggagaatcggtttttttactttttttttttttttttttttttgagacagagtctcgctctgtcgcccaggctggagtgcagtggtgtgatctcagctcactgcagcctcctgcctcccaggttcaagctattctcgtgcctcagcctcccaagtagctgggaccacagatgtgcaccaccatgcccagctaattttttgtatttttagtagaggtggggtttctccatgttggccaggctggtctcgaactcctggcctcaagtgatccacccgcctcagcctcccaaaatgctgagattacaggtgtaagccaccacacctggccctttggttttttgtttgttttagtttttcttccagtggccacttgtgtatgttgactgtggtctcttcttccatcttcaaagcacatgactccagtcaccctctcctttctgtcatcagatcactgtctctcttacagggacccatgtgattccatttagggcccaccccgacagccaaggaaaaacttcccacctcaagatctctaactgaactaaagtcctgattgccatttaaagtaatagatttgcaggttccgagataagaatgtgcgcatctttgggggttcgttattcggcccagcacagtcagggatggctcagcttcagtcctgactggatccaggggatcagatcgcatgctcatggcatccccctctccagctcgcagccctgctttcctcagcagctcccggcttaatccaccattcaacagccccagggaagagacagcacctcttccaaaagtgccagccaacgtccccgggctggttcccattggcccaccttagaccacatgttcatccttgaagcaatcactgtggccagggggaccttgggtccctctgattggttttcattgtccccaccccgtagtcttttgtttttttgtttttttgttttttttttgagacagagtcttgctctgtcatgcaggctggagcacagtggcgcgatctcggctcactacaacctccacttgctgggttcaagcagttctcctgcttcagcctcccaagtagctgggattacaggcagctgccaccacgcccagctaatttgtgtattttagtagagacagggtttcatcatgttggccaggctggtctcaaactcctgacctcaaacaatccacccgcctgtctcccacagtgctaggattacaggcatgagccaccatgcccagcctccaccccatggtcttgtcccacagagagaggtgtttccccaaggaaactgagtgggaaacagcatggcattggagtttgttcaatggcaagccctggggatagtgcctggcacatagtaagcgctcagtaaatgatgatcacagatcatgaggcacagcaggtgtccctccaggagccaatacttgaagagcacagggtttactaagcagatgtaggcaggagagcatttcaagcagggggaacacctttagcgaggcagaggtgtccaccatatggccagggtgaccaaatgtctggccatacttgggaagctggggacctaggggagtcctggtttgaacctatccccctagtataataccatccccctttaatgcaaaactctctctgtttggagagtatctgtatggtcactttccttgcagtcaacctgctcatttataaggaaaccaaacagacaaagaggatgagattgaacccaaggacctctaaccttgagtgtccaaatccagactagaacccgagcctgatgactcccagtgcagtgctcatcccagccctcagcttatgaggccaacccttgaaggctacatcagattaaccaggcatgttctctctctctctctctctctgtcaaattttccataggattgtgaccagatccacgttgatgacgtctcatcagatgacaatggccaagatttaaggtgggaatttggggagtcaaaaatgcccattgattgactgattgattatcaagttatccttctactaggaagtggggtgggagaggagggctgcttataaggacaaggtgtgcctgcctccagccagaactgggacttttgcatctcagactcaaaaatcacaactagccgggtgtggtggctcatacttgtaatcccagcactttgggaggtcttagcaggaggatcacttgagctcaggagttcaaaaccagcctgagcaacatagtgagacccccatctctactataataaataaatgagtaaaaatttgtttaaaaaatcacaacctcacccctcaaccctacagtctcttgctcatcacctcaaatcactaaactctgctcatttattgctatttttttcctgcttactgaagtaatgcatgcataacagaaaaaattcaaacacttaacctgacctcacctcccaaactcaccaccattaagagtttagtatatattcttcaaagatctgctcaaaatgttgaaaataccctttctttcagcttctctcctccaatcaagggtccggagatgttataaccaattttttctcagtagtcaagctcagagtttcacgtgcttctcctcctccagcagtcttcgtaaggaggcagctgcctccaaatatttggttgtattcattagcatacatatatatatttttttctttttcttttttttgaggctgactttcactcttgtcacccaggctggagtgcaatggtgtgatctcagctcactgcaacctccacctcccaggctcaagcaattctcctgcctcagcctcctgagtagctgggattacagtcatgcaccaccacacccagctaatttttttgtttttttagtagaggcggggtttcaccatattggccaggctggtctcaaactcctaacctcaagtgatctacccacctcagcctcccagagtgctggggttacaggcgtgagccaccgcacccgaccagcatgcatatatttttaatataacaattgatacagccaatacttaagaaacacttctcaaatgaataagtggtgtgtctggtttctaggggaaaacactcccaggacatggcttccaggaatcaggtaacccattgcttaatatgagacaccttcaggccgggtgtggtggctcacgcctgtaatcccagcactttgggaggccaaggcgcaaggatcacctgaggtcaggagttcgagaccagcctggccaacacagtgaaaccccatctctactaaaaatacaaaaattagccgggcgtggtggcgggcgcctgtaatcccagctacttgggaggctgaggcaggagaattgcttgaacccaggaggcggaggttgcagcgagccgagatcgtgccactgcactccagcctggggtacagagcgagactccgtctcaaaaaaaaaaaaaaaagagagacagcttccagaggaatgtgggctggaatgttccaagcctgcccctgggaaaactttgtaaaaatggaaccatagttaatctgtgctcatccaaaattaccacaattcaacggctttaggctcatcagatatattattagaccaactaatgttttggttacgggatcagtcattgtaactttatttagtagctgcttccaaggtgtctctcccaacttactgcaaaaacaaaaatcaaaatttctgttcctgagccctgcaagtcttttcaaagcccggcacaatcggaagtgatcagccggcagatgcctgcttcattttaatcagccattcggaaaatcccttctgcaatcaggactggcaaggagcaaagctccagccccaccaggacttctcacctgatggagtaaataaaccccagatcaaggttaattggtcctttccatgaagtcatcgttgggaagcactcttcctttcaaggcagtgagcagcaccgttctgtttctatagtttcccctgtagctagctggcttggaattgagagcaacagtcctctgaaccctgtctcatgctgagctgtttggtacctcactttgagaattctcagcccaagggtgttttcttccttagagaccaaattctccacttattcattcaagaaatatttatggagtacctactatatgctaggtcccaaacatgaaatgcctcttgtttgtttttttgttttgttttgttttgttttgtttttttcagttagcagtaagaaccaaccttcagagatgcctcgttttgtgccatgttctattctaaatgcattacatgggataactcattgcatatccacagtaaccctaggagagagagatgcttttatcctcatcctcatttttcagctggggaatgtgaggcatagagagattgagcaattggcccaaactcacatggctggtcagcagggaaggcaggattcaaatccaggcagcctggctctgggacccaagctcttaacagatcctctgtccatcctggacactggttcctgccctccccaagggcctccatctcctaacatctagacatctccccatggtagcatctgagttaatggtgagcgttcactttttcaagaataaatctatggccgggcacagtggctcacgcctgtaatcccagcactttgggagcccaaggcgggtggatcacttgaggtccggagtgcaagaccagcctggccaacatggtgaaaccctgtctctactaaaaatacaaaaaattacctgggtgtggtggagggcacctgtaatcccagctacttgggagggggaggctgaggcaggagaatcacttgaacctgggaggcagaggttgcagtgagccgagatcatgcctttgcactccagcctgggcaacagagcaagactccatctcaaaataaattaaaaaaaataaaaaaaataaaaaaataaaaagtcaaaataagggacgaggcacggtggtgcatgcctataatcccagcactttgggaagccaaggtaggaggatcccttgagcccaggagttcaagaacagcccaggcaacatagagagactccatctctccaaaaaataaaaataagttagccaagtgtggtggcgcacacacgaggagcctgtgggcccagctcctcggaaggctgaggtaaaaggatcccttgagctgggaggttgaggctgccatgagctgtgatgacaccactgcactccaacctgggcaacagcgcaagaccctgtctcaaaaaaataaaaattaaaaaataaatgaaaggcaaatggatgtggatcaggtaagagcaaaagacaccacttttcttggggaagctaatgaaagctgtggtcctgctgccccccaaatgcacactcgcagcaccctgtgcatttcgaggggctcatggacacccaaaagcccacccgtgggtcccacagagcctgtggtctcccagggaagatgccctgcacccccctgcactaacactgtccctcccctcctctctccgcagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtggtgagtactgtgagccttgggcctccgaggaagggaaactcattgggatggatgctgtcagtgtccctgctgtgccaggcgccaggcagagaggttcacaagttcagtaccagcccacttaatgcaaccctgacgacacccttcggaatagagcactgggattttgtcaccttcactttgggggtgggaaagctgagggacggaggctgcatctggtccaagatccttcaggccacaaatggcgcggggtggacgtgggggcggaattctcttacccacagccagaggctctcacagtgtggtcctccaagtagcagcgacagcatcacctggggatgtgttgaaaatgcagattctctggccctacctcaggcctagcaaatctgaaactctgcgctggggcccagaatctgtgttttcacagccctggaatccccccttggattctggaattccagaatccccctggaatcgggaggacctgtgccttgagtctttgcatctcagattgttgtccgcagaccaaccacatcagcatcccccggagctggttagaagtgcagggtcaccagcaggcagagtctgcagtgacccaagattacaccactgcaccccagcctgggcaacaaagtgagaccccgtaaaaaaaaaaaaaaaaaaaaaaacgtgcagggtctcaggcctcatcctgggcaactgactcagaatctgctttaaaaaatttttttttatttttgagacaaggtcttgctatgctgcccaggctggtctcaaactacttctggcctcaagtgatcttcccacctcagcctcccaagtagctgggattagaggcatgcaccacctgcctggcccagaatctgcatttttgacaagcccgccaggtgactgtggaggcattaaagttgaagaagccctagaagtcactggttctcacacgtggctctcattggaaccacccagggagtttcagttgctggtggtcttggtatcactgcagcctggacatcaggagtcataaagatccctggggaattctaagtgcagccaaggagagacccgccccctggcttcaggtactaggaacatttgctcattgccccaaacaagaagtctgaaggcactgaaggcgaggctggctcagccgtagtctagagaattctggagttctctagaacagaggtttttaactaggggtggtactgcgccctcctcaggagacatctgggagtcttcctggttgccacagtgcctggaaccaaccactggcccataagggcagggtttgagtaggtggctaatagtgtctgcaatatacacattggccccaaaaacttctagggccccctccctccattcctagaaagaatagagtcccggttctcaaactggacagaacacacttccagtcgcagctctacaactttctagctatgtggccttaggcaacatacatacggtcatcttaatgagccttagtctttaaatctatgaaatggagaatacaaatacttctgcttccctggattattgagagatttattgttagtgcatacaaaaggcatgactccatgcctgatacacagcgggaactcaataaatggtggcatttgtcacgagttgctctcagttttgcttgggagcctcgggttcccctgcgtcttctactgtccctggagctttcccatccgttctttgggacagacttcccgtcgtgttcatggctgcggtgctaatgcagcccacgtgctaagcgcggtcctggcagtagctaatgtttaaggagcactcgctctgccagttttgccaccgttttcatggactagctccttcactcttcacagcatgcctgtaaggtaaatgtttttatcaacggtgttgcttgaaagcagaaactgagatgacggaggttaagtaacctgcccagcgtcacacagcccaggcagaagggccacagtggagtcccaggctgggtgactgcaccacctctgcccttcagggccacacttggtggcctctcagatgtgagtgtgttgattgcaggagtgaagcagcaagctctggtcaggtcccagcctttgtacccagccctgcacggagggaggaggggagcaggagggctgactcaggtgagacagggatggggttggccgccagagagcatctgttccccatccaggttaaggcccaggaaatgccagggctttgtcaggctgctctgctcacccatagctgaggggagagcacccaaggcgtcagccagtgaggagcccacagccagcggcatgccggtctccttccccaacccagctgttcctgcatcacagaactagccaggtgcatggccgtggcttccagcccagggatcaccacagatccccacgattccaagtgttttagaaggtacactcggaagaaaggcatctgcaaaatacagaatagagaaaatgcttagtaaatcaccatctaggaggcaggggttgaaatcaggggccttagcctgatgtcatccttccatctaccacttcccatgtagctctgagcaggttatttgacctccctgtgcctcagtttcctcctcgtgtgcaaaatggggccagtgatgctgcccagcatcattggtagatggctaatagtgtctgcaatatacacaatatacacaaggattcatgccaggatgttgtgaattcacacaggaaaggtgctcagaacggcatctgacacacataagctctcattaagtggcacttttgttatctggggaaggtgggaaggaggccaagcctggaggaaaacgccgaggaaacagcttgaagcacacttcccagcgtggagcaaagtaggggtggttgggcagccagctacacaagacagcacgttgggaagccctttgtcaactgaaaagtgctgagccttgtgagtttgtattgttactgagggttccagctaagggtctgtggggaaggtgcagagacagaggaaaaccagaggccgtgtgttctcctagagttgatagactaatgagaagatgggacatgtagcagtaagaagattcattcattcattcattcttccacgtgtccatcgtcaaaggcctaggttgtggattcagcagtgaacaaaagaaacaaggtccctgttttcaaagagtttatattcagtgagtggaggaaacagaccatcaacaagtgagcaaatcacttaaattctttttttttttttttttttttgagatggagtcttgctctgtcacccaggctggaatacagtggcatgatctcggctcactgcaacctctacctcccaggttcaagtgactctcctgcctcagcctcccgagtagctgggattacaggcacatgccaccatgcccggctaatttttgtatttttaatagagatgaggtttcaccatgttggccaggctggtcttgaactcctgagctcaggtgatccacccgtctcagcctcccaaagtactgggattacaggtatgagccaccatgcccggctttaaattcttaattcagtcatttcgaggatgatcacacctattgaagaaacagatatggcagagagcccagcgtgggcagtggtggccaggggatacttggaatagtagacccagagtccatctctcaggaagggctatttgaactcagtattctaaatattctagatgagattctaataatgataaccagatgcccagagctggggaatgaccaatacaagcaaagagtcaatcagttcagctacattcaactgcataagtaaaagaacaaccaaccaaaaaataacacaaaaaacaacaatggcttaaaccagatagaaatgtattttttttcttatatacaaaagctgtaggcattccaagctggccaagtactctacagtgttatgagcccaggatcccaggatccttctttctttttttttttttgagacagagtctcactctgccacctaggctggagtatagtggcacaatctcggctcactgcaacctccgcctcccgagttcaagcaattctcctgcctcagcctcccaagtagctgggaatacaggcgcctgccaccacacccggctaatttttgtatttttagtagagatagagacgggatttcaccacgttggccaggctgatctcgaactcctgacctcagatgatctgcccgcctcggcctccaaaagtgctgggattacaggcatgagccaccctgcctggccccttctatctttgtatttatttatttatttattgagactgggtctcactctgtttctcaggctggagtgcagtggcatgatctcggctcactgcaccctcgacctcctaggctcaagtgatcctcccacctcagccttcagaatagctgggaccacaggcacatgccaccatgcctggctaatttttaaattttttgtaaagatggggccttcctgtcttgcccaggctggtctcaaacccctggctcaagcgatcctcccacctcagcctcccaaagtgctggggttacaggcgtgggccacctcacccagccaaaatcaggattcttattactaatgagaagatccttttgtatttatatttttactaattacaagtgaaaaaaatggatagtggatggcaactaagtgtctaccacaaacagcaaatgaaaagtctctgagacaaaaagagtttgacacttttcagaaagataaagaaggccagcatagctgaatagctggagtgagggggcacgtggtccaggacaggatgagagagctggcggtgtccagatgacataaggcccagtttggacactgggctcttctatgtagagaagacgatgtctccatagcacaggcagcattttgtcctaattaattcattcttccttcaacaaatactgattgagcatcaagcacaggccagcccctgctacagaaactgctgctatgatggcgaacaagactgacttggtccctgccctctgccctagagtgaatagcctaatggccaaggcagatgccaaacacatcgtcacacagatacacttaaaattagagttgtgagaagtgctgtgaagaagagctacagtgtgttgggagaatataaactaaagggacctgacccagcctggagagatcaggttagaccttccagaacaaatgacatttaagatgaggccgtaaggcaggatgcagaggttcacacctgtaattccagcactttgggaggccaaggcaggattgcttgaggccaggagttcaagaccagtttgggcaacatagcaagaccccacctctatgaaaaatacaaaatttagccggacatggtggcaggcatctgtagttccagctactcaggaggctaaggtggaaggattgcaggattgcttgaacctgggagactgaggctgcagtgagccttgatcacaccactgcactccagcctgggtgacagagcaagatcttgtctcaaaaaaaaaaaaaaaagacaaggcccaaatgcagagtgtgaaggatttagccaggcaaaagcagaagatgagataaaagagtggtccatgttctgaaatgaggtgtgcaaaggtcctggggcaggagtccacttggtgtttcagggaacaaacgaggcctccaggctggaatggaaagacagcggcaggagatgaaactcagtagggacaggatcatgctgctgggggttttgaactttatcttaaagctactgaaggctgagagaatggcaggttgagaaatacccagggtagctctggaagccagctgcctgggtgccggacctgtgtccatttttgttcatatctgtgcattcagtgcctattacaatatcaagcacctagaaggcactcctgaattttttgttggatgcatggatggatgaatgtgggggtagataggtggatgggtggatgggtgggtgggtagatgggtggatgggtgggtgggtggatggatggatattgggtggatggatgggtagatacgtgggtaggtggatggatgggtggataggtgtctattattttctccctatggtgagcaagtcagtcaacatcacaaagcctgtttctttacctaaaaatatagaaataaaaatggtgtccacctctatggtcattgtgagaatgaaataaatcatgttaaaagcagagccctgcacataagcactcaaaaatgttcatcattttttatgttattattaattccctgtctccaccataacaatataagctctataatctgcatatttttgttcatatctgtacattcagtgcctattacaatatcaagtacttagaaggtactcctgaattttttgttggatgcatggatggatggatatggggtagatgggtggttgggtggataggtgggtgggtagatgggtggatgggtgtgtgggtggatgggtggatgggtgggtgggtagactgatgggtgggtgggtgtgtgggtagattgatgggtgggtgggtggatagatggatggttggatattgggtggatggatggatgggtggatggatggatattgggtggatggatgggtggataggtgggtgggtggatggatggatggatattgggcagatggatggatgggtggatggatggatattgggtggatggatgggtggataggtgggtaggtagatagatgggtggataggtgggtggatggatggatggatgaatggaagggtggatgggtggatgggtgaatcagtcagtggatggattaatctatcaatctgttgatctcaggataagattgagagaagccactggattgaagtttactttgggttgtcatctgattttaaccctcagggtacagtagctagattcctgttccctaccttcatcccccagatctttctaatacgatgactacatctttatttcctttgtccacagggttgataggcactcccaaaagggagacctggctacagctccgagctgagctggaagctctcacagacctctggctgacccactccctgaaggcactaaacctcatcaactcccggcaagtggcagccctcattttcctctgtgccactgaactttctcgcagtagacagtggtggctcctgcatgtccacacttgggagaattggactcctcaaactctcacttgtacactttccaaatattttttttttttgatatggagtctcactctgtcgcccaggctggagtgcagtagcgtgatctcggctcatcacaacctctccctcccaggttcaagcaattctccggcctcagcctcctgagtagctgggattgcaggtgtgcaccaccacacctagctaatttttgtatttagtagagatggggtttcaccatgttggccaggcttgtctcgaactcctgacctcaggtgatccacccgcctcggcctcccaaagtactgggattgcaggtgtgagccaccactcccagcccaaatatttaataaagcttaagtgcacaaggctcagtggataccttggagcatagctgagctaatagcggcagagacttttcagggcccaacaggtttccaggtttctggattctcccaaaagatgagaactggcatgcaggctccagcttactctattccccacctctccctcttgtcctacacttgttccatatcactcatttacattacccgcaactatttaagtgtatggcccttgcaataaacatttgctttttatataagaaaagtattccccccatactacatttcactatgtcaggcagcttcaggcttaaaagagaggaacagcctgagaatccttgggccctaacatacctgaagatgacagccatagcctccaagcctaccagatttcccgccaactgcaggctcatgcagcaagaggaggcctggccttgtggtccctctgagttctgatccacagtctcctttgtccttaggcccaactgtgtcaatgtgctggtcaccaccactcaactaattcctgccctggccaaagtcctgctatatggcctggggtctgtgtttcctattgagaacatctacagtgcaaccaagacaggtagggagaagccacacctcggcggggatacagggttggagggtggggttagctttccatcctgggaatggggtgtttaaggaacatgacaccacagaaatggatggagtgtgcctatggccatgactcagattcccaaaacagcccccatagaccacatgccttaacctctgcttctaaagaaattggttaggaccacagttttccaaagtgtctgtatgagttcagatacaggcaaagctgctgtaacaaacacaccccaaatgcaagggcttgcaaaagagtcaaagctgatttctccctagtagaacagacagaggtgagtgatccaggctggtggggtgaccctgtcctcagagacatccagaaacccaggtctctcccgttttatttttccaccatttcttatggttttattctcatgtatggggtcaaatcagagtcctagcccatcctcattctagcaggtctggtatttgaaggccaagctcagaaggctatgtacattacattctactcacttcctgttagccccagcttagtcacgtggccacaagtagctgccagggaagctgggaaatgtagtccatagctgagtgattcatactgtcactcaatctggaatgcagtggcgagatcatagctcactacagcctcaaactcccagcctcaagcaatccttccacctcagcccccaaagtactgggactacaggcatgagccaccgtgccaaaatatttttaattagaaaccttttccattgttttttctctagagcaaaaaataaaaaaaataaataatttatagtactttggcagcattttcttggagcaattttggttttactgaagttctacgtccaaacattatatgaaagtgccttttgattttaaaattatagtagtaggggccaaaatggttgttgaagatttttcaacaagatcctgtcttttcatttttcccatttttcctgcatacctcaagtacctttgcaggtttatttcgaatctcttttttaaataatatttttatttttaattgtggtaaaattaaataatgtaaaattttcaccatcttaaccttttttcttttttttaagatggagtttctctcttgttgcccaggctggagggcagtggtgcaatctcggctcactacaacctccgcctcctgggttcaagcagttctcctgcctcagcctcctgagtagcaaagactacaggcgtgcaccactacaccgagctaattttgtatttttagtagagacggggtttcaccttgttggccaggctagtcttgaactcctgacctcaggtgatccatctgcctcggcctcccaaaatgctgggattacaggcatgaaccaccgcacctggccatgcactatacgcttaaaaatggttaagatgggtcaggcgcggtggctcacgcctgtaatcccagcactttgggaggacgaggcaggtggactgcctgaagtcaggcagttcaagaccagcctgaccgacatagtgaaaactcatctgtactaaaaataaaaaaattagcagggcatggtggcgggtacctgtaatcccaggtacttggaaggctgaggtaggagagtcgcttgaacccaggaggcagaggttgcagtgagccgagaccaggccattgcactccagcctgggcaacaagaacgagactccgtctaaaaaaaaaaaaaaaaggttaagatggctgggtgcagtggctcacgcctgtaatcccagtactttgagacactgaggtgagcagatcacttgaggccaggagttcgagaccagcctggccaacatggtgaagccccatctctactaaaaaatacaaaaattagccaggtgtggtgatgcgtgcctacagtcccagttactcaggaggccgaggcaggagaatggcttgaacccagaaagtggaggtttcagtgagccgagatggcaccactgcactccagcctgggtgacagagcaagactgtgtctcgaaacaaaagtgtccagcgcagtggcatcaagtgcattcaaatggttgtgcatccattgccacttctacatcggacagctgcagagacttgggagcctgctctaacccctgcgctgcctcctcctgctgtgttgccctgggcaagctactgaccctcgctgtgtttccggctgtcatcatccttcatgtggggatgataacagggctcacctcagaagtttgctcaagaacgaaatgatgaataccgggcctttgggagcacagctgcaggcaccaagctcttaatgagcgggtattggctgcaatccggggtcctcacagagcgttttttctttccttcctgtgtgcgtgcagggaaggagagctgcttcgagaggataatgcagagattcggcagaaaagctgtctacgtggtgatcggtgatggtgtggaagaggagcaaggagcgaaaaaggtacttcttccacctctcagactgcgttttcctgctctttcgagcacccctcgtggtcttcaagggctccttccatgatttcctccactccccgtggctggctgggtcctccttcccaggctccttgcttgccagtccattccatttgcaaattgcagaagcatcctgagtaatttccttctacaaatccccctctctgcctctggctgctgcccctggtagccctggattgtttctgggacaactgttcgggagcctagagacgctccggcagggcaggctggtggggggccagtgcacgtgcatgtgttttatttaatacttactgatcatatgttccagcaacccttcccagttaataaagacagcattaagctaatgaaaaagaaaatcctgcatttgtgatctcgggcccgtgaggagagggcagggggttctggtggccacatctctgttcttggaaaagaaacagctgccaaagtcctgggtctggatctgtcaacagcgccccagagaggctgccacccccaacccggaggcctgggaagtggattgttaatgtcacagaccttaattagggggacctggtttcccccatctctgcctggcagcaaatcccaaggaaatgcaaaaatgttcagggtctcagcagatgaaacccagaagaagagggaagccctagggtcctgggagagggccccgggagagaggagcttggaaggctttgcaggcactgttccctccacctggaaggctcctcccctttcctgggagatgtagtctctattatccgccgccatgagccccgctaagaaatgggagctgcttctgagagagaaggggagaagtgatattgaggggcagctgccagggtcagtcgcactggtgtgtggccaggctgtggctggcatcttgagttgctgacctaaccccatgcccttcaccaccgtaactttattgctaacatcatcattgtactcaatcctccaaaaactcctacaaagtgggtatcattgcatccctttttttttttttttttttttagagatagggtctcactctggcacctaggctggagtgcagtggcacaatctcagcttactgcagcctctacctactggactcaagcgatcttcccacttccacctctaagtagctggagctatggacaggcaccaccatacctggttaattttttgtatttttttttttatagagatggggttttgccatgttgcctgggctggcctcaaactcgtaaactcaaacaatctgcccaccttggcctcccagaaagctgggattagaggcatgtgcccggccacaccccattttatagatgacagaatttgagactcagaaaggttaattaatttgcctagggtcacacatctagcacatgcaaacctacctgtgtcatgctccaaacgcctggcagggaggagacggacttacgagtttcaaacacggttggttttcacccctgagctagtcaggcaagagtagagtcagccaaagaagactaggtacacacccaccacacacagaactcccataaaagtcccagtgtctgaggcagaagcctcagaacgttagtgagaaacagtgtccaccagcagctctctcagcctgacaaatggaagtcattagcccaggccaccggaaatctgagcggtgtaaaatatggccgcaggaccaggggccttgactgtttccgctgacagtgttgttaatatctccattttagtgggtgatttgtctccacctcttcacgagtgatgaatccactggcactctggaacctttaagcctggggtaaaggcggctagaacattctctttcttccacctttgctcattctctcccagaaaaatgaatcacactcttttttttttttttttttttttttttttttttttttttttttgagacagaatctcactgtgtcgcccaggctggagtgcagtagcatgatctcggctcactgcaacctccacctcccaggttcaagcgattcttgtgcctcagcctcctgagtagctgggattacaggcatgagccaccacatgtggctaattttttgtaattttaatagagacggggttttgccatgttggccaggctggtctcgaactcctgacctcaggtgatccgaccacctcagcctcccaaagtactgggattagaggtgtgagccaccacactcagccaaattacactctttaaagagggcaggattggccaggtggcaaccagaatctatctttgcaaagaaaggagggcttggccgggatgagggcagggtgggaatgctagggcagtgagaaggcgttgaagagatgagagctgttcccataggagatggttttctgcttcccttgagctgagaattgtttagaaactacagaacaaagagaaaaggatacattcagaggactttgcttgagaaacttaccttctttttttccctctctctcttcctcttttcattccttctacgaatatttcttgagcacctactatgtgtcaagagccatgcggtgcagcaatgagcattgcattccaagctcaaccttcctggggcctttgcacttgctgtgtcttctacctgcccccacgttcccccacatctttgccagggcctgcttaaatgacactccctggagaggcctttcctgacccagctctcaaaagtagacacacaaagctgctttctaccctatctcattctgtttccttcctagcacttaccaggagatgaacttatcttgtttatttcttatctgtgggtttatctgagcctccaatgaaagccccataagtgtttgtgacctgtacagaaggccccactggggtctgcccctggcatctttatagatcttcctttgctcactgagggattctcaatctgggatgcccttcccttcagtgacctgctaactatgaagcacttattcttttttttttttttttttttttttttttgagatgaagtttcactcttgttgcccaggttggagtgcagtggcatgatctcaactcactgcatcctctgcctcctgtgttcaagtgattctcctgccccagcctcccaagtagctgggattacaggtggccaccaccacgcccagctgattcttgtattttagtagagatggggtttcaccatgttggccaggctggtctcaaattcctgatttcaggtagtccacccgccttggcctcccaaagtcctaggattacaggcgtgagccaccacgcccggcctcctcattcgttcttcaaggtctgggtctcatgcgcttcttgtcccctgagacacccccatcccattcacttctaccaaaaaagaggctgcttcctctggctggctcccatgacattttatttacacctgccttaatgatttctttacattcttcctaaggtagtcttatttattatcttttaaactactgagaaacgccagcattctttcttccatatacatgcacatatatatacaatttgtcctgcatccttcctttttcctatttacctagatatgtccctagctactcaggaggctgagtcaggaaaatcagttgagcccaagagatcaaggctgcagtgagccatgatctgcattccagcatggacaacaaactgagactccatctctaaaattaaaaaaaaaaattaatgaaacgaaattcagctgggcacaatggctcatgcctgtaatcccaacactttgggaggctgaggtgggtggatcgcttgagcccagtagtttgagaccagcctggtcaccatggtgaaaccctatctctacaaaaaatacaaaaattagccagatgtggtggcatgcatctgttgtcccagctacccgggaggctaaggtaggaggatcgcttgagcctgggaggttgaggctgcagtgagcagagatcatgtcactgcactctagcctgtctcaaaagaaagaaagaaagaaaaaaaaaactccacatcatgacaataacttgaagcaggtaccacctgctgcaaagaaaaggaaaagataaaaacgaaagctataaagaaaacagattagtgtcatctgacctggctagctacagtggcctgctgaagactctccaagaccagctctgtttgttcacagtggagactgtcaatgctggggaggggttccagcaccgagctgtgactttcttcttgaagtaacaggattcagagcactgcagcctccaattcccggcctcaagcaatcctcccgcctcagcctcccaaagtgctgggattacaaacgtgggccacagtgcccaggcaagaacaaatttttaaaaaggaatcgctttcccattgtgcaatttaacaccatgtcagtgcaccgcctaagaccacgctggtaccaacagaggcgagagggtcaaacagcgaacacgctgggcagtgctggataagcccgtcagagcaggctctgaatagaaatggttggccatactggtgggtactggccagatgtgggtctgccagcaacatcaagtgccccatagtttgggaagtccccacgtgctagacttaactgggttgacttctcacatgccctctaaccacaggcgtggaacccgggggcaggggcggggccataaccttgtggctggtgttctgtgtttcagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaagtggggtaggatgtggttactttattaccactcttgaggcttccaaatgtgttgtcctttttaaagactttatcagttgcagaagaatagaatccaactcacactggcttaagccaagaaaaatggggtggggggagggaggaaggagaagagggagaaaaggagggaggcagaaagggaggggaagaaggacaaagggacaagtgtctccaggaactttaggtggtatctgtctggatccgggtggtcaaatgaatttctctcatgtggccgtaattctcaggcaggctgttccctgtgtggcaaagacggctctacgagtccttcagcaaaaccacacagacagaaagagaccacattcttcaccgtggtgcagcgaaagcctcaggactgtaactcgttggccaaatctgaggcttaggcaactcacggagctggatttagggttggatcctgtcacgaacagcaagttgaacaagctgatcctccaagggaaagaaaatcagtgagctgttattcaaagaattgggggaattgagggtcgggctggaaaatgcaactgacttccgttctaatggtaggacttcatttcccagtggatgggacatgagtgaaggatccagtttaaggggcaaggagggaaatctggagaagttctgaagacatctggagcactgccactacccatagtggaccaggcaggacctgggtctatctgattggatgctaagcaggaatataggctccttccttattaatgctggtaaaatcgtggattatcagtcagctgacccatgtcatgggagatggagatctctgccactggagtctcagagctagaatctctgatgattagaaaactgtcaccggccaggcatggtggtgtatgcctgtaatcccaacactttaggaggccaaggcatgtgggtcgcttgagcccaggagtttgagaccaacctgggcaacatggtgaaaccccgtctttacaaaaaatacaaaaattagctaggcatatagcatgcgcctgtagtcacaactactcaggaggcagaggtgggaagagctcttgagcccaggaggttgaggctgcagtgagccaggttcacactgctgcactccagcctgggtgacagagcaagaccctgtctcaaaaaaaaaaaaaaaaaaaaggcatcactaagggtcagatagactcccttactagaccctgagcttctcagggggtaggtactgttggtttcatctctatatccacagaatcaagcacagagcctgacacaaaatagaatcccattatagatggcatagaatgaaggatggaaatatgaatggaaccacagccagatggatgataatatgggtgaatggccatttggacaaatggataaaatggagtgttaaacagttgagtacgtgggtagatgaatggttggttaggtgattagatgattaattggaaggtgggtgggtaattgggtgactggaagatggatagatgaataaatggatacctacttgggatgactagatggatagttggataaatcatgggtatatggacgaacagatagattattggatagatgaccagatcgataaccaagtagttgtgtggtgacatgaatgaatagatggtggtttggatgagtgaatggctgggtggttttacggaaatatggatagatggttaggtgggtgagttagtggataaatgagtgggttgtttggacaggtagatggatggaatgattgatggttgttggtggttgataataatattatgatggatatgtggacagtttaatgggcaggtggatggaaagttaaatggaaatgaagtgtgatggttagatggatagagagtggaatggaagtgaagaatctttagcattgcctaaaatacctgagtcagcctcactaatatctgtcagcttaggtttcttctagaatgagtggaggagctttactggataagctgacttctagctggagtggataatgagactagagtagagccacccagtcaccaaccatccactggtagtcagtgatgtgaatactcctgaatccccctgactccccattctttagcacccttgccacacaggaacccacttataatcatgatctacccatctctcccttcctgctaccatcaaaacctgctgtcagggaaaattctgtttagggtccaacaaagggtaaattacttattaagaaaattttttcttttagtaggatttcattagaaacacaagtagaatttcagccatgcacacaggaggttttgggtgaaacagatcttccccttgaccctgaaattaaactacgtaggtgatcaactacttttttgttgtgatgagtcaatgtcaaagactagttctgacaaaagttagcagtccacagtctttaaggtaagtgttttaacttgaattccttctggatgactcagagcttctgctgagtaaggatagtatttttctcatctctgtatgctcattgcccatcacagagcctggcacagatatgccacttaatgaatgttggatgggtgaatgagtagataagtggtggatggatggatggatggatggatggatggatggatggagagatgggtgaatagtagatggatggatggatggattagtggatggtggatggatggagggatgggtgaatgagtggatgcatggatggatgtagatggatggatggatagatggataggtgaatgagtggatggatggatgataggtggacagatgggtggttaggtggatagatggatagatggatgactgggatttcatggtcccaggcttctagacttcactgtttccccagcggtgtcttgctgctctccagaacattcttagaagtagagtaacaggactattcaagacacacatacaaaagcttttggactctcagaagtccaaccttgactccagaacttcctgagcagcccagcagaaggatagagacccaca

SEQ ID NO: 2 - DNA, 1912 bp, Homo sapiens
ccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaatttttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcaaaaaaaaaaaaaaaaaaaaaaa

SEQ ID NO: 3 - DNA, 1704 bp, Homo sapiens
cctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttggtgagaggccagcacagggagggagggtgtctgctggaagccaggctcagcgctcctgcctggacgcatcccggctatgcagccccagtccagggcagcaaggcaggccccgtctgcctcttcacccggaggcctctgcccgccccactcatgctcagggagagggtcttctggctttttccccaggctctgggcaggcacaggctaggtgcccctaacccaggccctgcacacaaaggggcaggtgctgggctcagacctgccaagagccatatccgggaggaccctgcccctgacctaagcccaccccaaaggccaaactctccactccctcagctcggacaccttctctcctcccagattccagtaactcccaatcttctctctgcagagcccaaatcttgtgacaaaactcacacatgcccaccgtgcccaggtaagccagcccaggcctcgccctccagctcaaggcgggacaggtgccctagagtagcctgcatccagggacaggccccagccgggtgctgacacgtccacctccatctcttcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaaggtgggacccgtggggtgcgagggccacatggacagaggccggctcggcccaccctctgccctgagagtgaccgctgtaccaacctctgtccctacagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtgtacatacttcccaggcacccagcatggaaataaa

SEQ ID NO: 4 - DNA, 6027 bp, Homo sapiens
ggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatgaaaaaaaaaaaaaaaaa

SEQ ID NO: 5 - DNA, 4279 bp, Homo sapiens
agcgggtgaggcggggaggcggcggccggtcggcccggcccagcccagcccgcagctgcggcggcgctcagagttggttcctgaccgccttctgccgcggccgggtttgtcaccaggtcctggggtctgcaccggctcggccagacctcgccccccgcttctccgccatggccctggtgcggggcgcggagccggcggcggggccttcccgctggctgcccacgcacgtccaggtgacggtgctgcgggcccgcgggctgcggggcaagagctcgggagcgggcagcaccagcgacgcgtacacggtgatccaggtgggccgcgagaagtacagtacgtcggtggtggagaagacgcacggctgtcccgagtggcgtgaggagtgctccttcgagctgccgccgggggccctggatggcctgctgcgggcgcaggaggccgacgcgggcccggcgccctgggccgcgagctccgccgccgcctgcgagctggtgctcaccaccatgcaccgctcgctcatcggcgtcgacaagttcctgggccaggccacggtggcgctggacgaggtcttcggcgcaggccgcgcccagcacacgcagtggtacaagctgcactccaagccaggcaagaaggagaaggaacgcggcgagattgaagtcaccatccagttcacgcgcaacaacctgagcgccatgtttgacctgtccatgaaggacaagccaaggtctcccttcagcaagatcagggacaagatgaagggcaagaagaagtatgatctggaatctgcctctgccatcctcccaagcagcgccatagaggatcctgacctgggcagcctgggcaagatgggcaaagccaaaggcttcttcctccgcaacaagctgcgcaagtcgtccctgacccagtccaacacctcgctgggctcggacagcaccctgtcctcagccagcgggagcttggcctaccagggacctggcgccgaactcctcacccgctcaccaagccgtagcagctggctgtccactgaagggggcagggactctgcacagtcccccaagctgttcacccataagaggacctacagcgatgaggccaaccagatgcgagtggctcctcctcgggcccttctggaccttcagggccacctggatgctgcctcccgctcttcgctctgtgtcaatgggagccacatttacaatgaggagccccagggccctgtgcggcaccgcagctccatctcgggctcgcttccatcctctggctccttgcaagctgtctcttcccggttctccgaggaggggcctcgttccacagatgacacctggcccagaggcagtcgtagcaacagcagctcagaggcagtgcttggacaggaggagctgagtgctcaggctaaagtcctggcccctggggccagccaccctggagaggaggagggggcccggctaccagagggcaagccagtccaggttgccacacccatagtggcctcctctgaggctgtggcagagaaggagggagcccggaaggaggaacgcaagccccggatgggtctcttccaccaccaccaccaaggcctaagtcggagcgagttgggtcgccgaagctctctgggggaaaaggggggtcccatcctgggggcctccccacatcactcatccagtggggagggaaaggccaagagtagctggtttggcttgagagaagccaaggacccgactcagaaacccagtccccaccccgtgaagcccctcagtgccgcccctgtggagggcagccccgacaggaagcagtcccgctccagtctgagcatagccctgagcagtgggctggagaagctcaaaacagtcacatctgggagcattcagcctgtgacccaggccccccaggctggccagatggtggacaccaaaaggctgaaggactcagctgtgctggaccagtcggccaagtactacaacctgacccacgatgagctcatcagcctgctcctgcagcgggagcgggagctgagccagcgggacgagcatgtgcaggagctggagagctacatcgaccggctgctggtgcggatcatggagacctcacccacgctgctgcagatccccccgggcccccccaaatagccttcctcaccctacccccaggagggttggcatggacctattgctgcctgccctctctcctcctgaactctctcatctgcagtggggcatcgtctgtcttgccttgtcactccttgctcctctccctcctgcctcaactggggctgctggaagggggccctctggattccctttggaggcatcaggttctgtgcacaacttgtgtgtctttgggagccctgggtctttcccacctgcctgttttcatatccctcagctttgggggccccagggaattggaactcttcccccaagacagagcaggggtgaactgtagcttgatgcagtaatctgggacaagactggttgctagcacatactttattatcccccaaggatggtcagccatttcttcccacagccaaagccccatccccttcatttccctccagtccctggaggggcttctagtattactgggacaatgaccacgctgcctgtttgtctgtgagttacgggcaaccagcctcttcagcctcacacccattcccctgagagcaagaagcctgtgtggtctgggccagtctctgccatgtcctgagtctgcttcagtctggagctgtttgtggggcgagtgccatgtggacagtggtggatgatgtgtgtgcttcaggctgctccctgacccctctgacctttccacgagtgtcacatgggaatgtgtggggcgcaggggcgggtgcggagagagcacctttttgcttttcgagctcttgaccacctccaatgtgtaggtccctccaggctggggcttgggactgcttatgatttggggatcaagcctccatgtctattcttgttgcctgtccagatgccaaaactctgtgttgctgcagggtttgaacttttggaaaccaattaaaatgtgcctttggtgggcggggtcaagagcccctggatgtcgacctctcccgctgtgtggcgtccccctcccacctgttgaatacatagggatggctctctcagggccctgggaatgggaatggacagcactgctgtgggctgttcccctcccctaaagttaatctcttggtctggccaagttgctgctccctcaaccttcctgctgtcttcccctccctcaaccccaataggaggatcccaggataaacactgctgggcaggcgggcaggcaggcctggggctgccctgctcactctcattgtctggcctcaggacttagccatactagactagtcagcttgcctggaagagggaggtcccactatgcctttgggagacacctatacttaggaaaaagcctttgttgtcctcccatccatccattaagctgctatctcagcctgtcccttctgccccaggggcttgcctggcttggctgcagtgcactttgaaatgaagtatctgtcctttggcccagcccctggtttgcttgtagaaaacatggtaggcttccccaaggcatctgcagggaactttggcagcttggggcaccctgaattagcaaaaatggggggtgatgaggtgctgaagaaggatacttaacagcttagtgaggaggcaagagctcctctgggaccaccacttcttcaggagagggcctgtgggcttgcttttggaaggcctcaggcagacacgtgccctctgggtgatgtctgtctgctgccaggatggagcagaggagcgccacacatggaggaaagcccctgtaacgttacctaccttaaactccactcatcaaatctgagaaaagtatccactggtccccagggtttcagtcatgcttttgggggtcattgggtattagagaagtaagtatcttttctgagagagggggagtcaccccccctactggggattcctctgggctttattcactcccagccctggccctgacctttgtgggcctccctaatgcccagggcatggatggcttcagaggagtttttgaatcgaagcccagggtccttgttgatgtttcttctccgagccacacttggaggaaagttgcaggtgggttgggcagggagcaggcatggttctgctttgctgtttgtcttcctagttaaggctctttataaagagcttcttcttcatgttttaagcactttatgaagaataaaacattcatgtactacaaaaaaaaaaaaaaa

SEQ ID NO: 6 - DNA, 2383 bp, Homo sapiens
gctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggacaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaa

SEQ ID NO: 7 - DNA, 1517 bp, Homo sapiens
gcgaggcaggagccggcggctgggctccgcagcgcagccagcgcagcgcggcgccccgggcccggccccatgcccgcagccccgccggaccgtccttgagcgcgggcgcctagcccgcgccccctgcccgccggcaccattgccccgacggcgcggccgggcggcccggcgctccccaggctccgcgcgggccgaaagacgctgctagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccggcacctactttttcacctaccatgtcctcatgcgcggcggcgacggcaccagtatgtgggcagacctctgcaagaatggccaggtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatctactccgactgagctccccacgtctccctccacccacgtccctcacccgccggggtcccctccgggcggggcagacgatgactcgcccctcgcccacccgctcgctgcccggccctccccggctatgacgcccccggcccgtgctcaacaccgcctgggccacagctaggccctcccaccggctcgctgcagagccgggcccagcgcgccctgtccccgtgccagggaaccggggttgaccgcccccgcccagcccgcgctatatatttgtacaataggactgtttactgcccacctccgcctgccagcccaccccagcctggggagaggtcgcggcggcgggtttgcttcctgcgctctgagatgagctgccctcggctccctccggggtggcgcgcccgggggaggggggagttgggggctggatagcttcccagcaccctcagagcccccgcccggctgtgccccgtctgaccaaagttataataaaaacattttcaccccgcaaaaaaaaaaaaaaaaaa

SEQ ID NO: 8 - DNA, 5050 bp, Homo sapiens
gccatttttcagctgccggccgcagcacccgggctgccgccgccgcctcgcaatccgttgcatcggccgcccccgacgcctccatccccgcttggggcccgatatccgtgcggccgggaccctcctctctccagagccccgattatttttggcccccggggcctgtgcggtgcggaaaaataaaaagaaaagagagagagggggctcggaagcgccgggcggggaggagagaaggaggagagacttggaaactccgactgcaaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagccccggcttcgccgccgccgccgccgctgccgccgccccgggcgcgtacatccagatcctcaccacgaacacttccaccacctcctgttcctcctccctccaaagcggcgccgtagccgccggccccctcctccccagtgcccccggcgcggagcagaccgccggcagcctcctctacaccacgccgcacggaccctccagcagagccgggctgctgcagcagccaccagcgctgggacgcggcggcagcggcggcggcggcggccctccggcaaagcgaaggctggagctaggagaaagcggtcatcagtacctctcagatggtttaaaaacccccaagggcaaaggaagagctgcactacgaagtccagatagtccaaaaactccaaaatctccctcagaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgggctgcagtctgtctgaggatgggggcatgctggcccagtgtcaaggcctgtcaaaagaagtgaccgagctcagtcaggaagagaagaaattagatgaactgatccaaagctgcaccctggacctcaaactgttaaccgaggattcagagaatcaaaggttagcttatgttacatatcaagatattcgaaaaattagtggccttaaagaccaaactgttatagttgtgaaagcccctccagaaacaagacttgaagtgcctgactcaatagagagcctacaaatacatttggcaagtacccaagggcccattgaggtttacttatgtccagaagagactgaaacacacagtccaatgaaaacaaacaaccaagaccacaatgggaatatccctaaacccgcttccaaagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagttaaaaaaaaaaaaaaaaaaaaaaaaagaaaaaaaaaaaaaaa

SEQ ID NO: 9 - DNA, 2169 bp, Homo sapiens
ctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtgacgcctggccctgaggtgaactggcccacagaggtcacaggctgaagcgtgaactccagtgtgtcaggagcctgggcttcatctttctgctgtgtggtccctcatttgg

SEQ ID NO: 10 - DNA, 1281 bp, Homo sapiens
gcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgccaattcagaatctgagggaagcagtagtgaggaggaagatgacgctgcagagcaggaaaaaggcattggatcagaggatgccaggaaaaagaaggaggacgaactctgggccagcttcctcaatgatgtgggaccaaaatcaaaagtgcccccaagtacacaagttaagaaaggagaggagactgaagagacaagttcaagtaaattgttggtaaaagcagaagagctagagaaacctaaagaaacagaaaaagttaaaatcaccaaggtgtttgattttgctggtgaagaagtaagggtaactaaggaagtggatgctacatctaaagaggccaaatccttcttcaagcagaatgagaaagaaaaaccacaggctaatgttccttcagctctgccatcactccctgccgggtcagggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttccttgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatgaagatgaaa

SEQ ID NO: 11 - DNA, 845 bp, Homo sapiens
agcacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcaaaaaaaaaaaaaaaaaaa

SEQ ID NO: 12 - DNA, 5086 bp, Homo sapiens
  misc_feature (27)..(27): n is a, c, g, or t
  misc_feature (46)..(46): n is a, c, g, or t
agcaccacggcagcaggaggtttcggnctaagttggaggtactggnccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtcccgctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcatggtgctgtaggtgcccctggtcctgctggagccacaggtgaccggggcgaagctggggctgctggtcctgctggtcctgctggtcctcggggaagccctggtgaacgtggcgaggtcggtcctgctggccccaacggatttgctggtccggctggtgctgctggtcaaccgggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctacctggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacggttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccatgaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 13 - DNA, 2910 bp, Homo sapiens
acttccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaacattttgaactctaaaaaaaaaaaaaaaa

SEQ ID NO: 14 - DNA, 1423 bp, Homo sapiens
aagtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcatttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaagcagaaaaaaaaaaaa

SEQ ID NO: 15 - DNA, 10540 bp, Homo sapiens
aggagccggaggaggagccgccgccgccgttgacccggccgccggccgggagctgggagagatgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtgagaagcgctatgtggtccaggtgagggaggatgtgactccaggggccccagtactccgagtcacagcctcggatcgagacaaggggagcaatgccgtggtgcactatagcatcatgagtggcaatgctcggggacagttttatctggatgcccagactggagctctggatgtggtgagccctcttgactatgagacgaccaaggagtacaccctacgggtgcgagcacaggatggtggccgtcccccactctctaatgtctctggcttggtgacagtacaggtcctggatatcaacgacaatgcccccatcttcgtcagcacccctttccaggctactgtcctggagagtgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactatgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtctttcagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcccggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccggagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggaggcccccctccccgcccaccgccccggcagagcctccaggagcagctgaacggggtcatgcccatcgccatgagcatcaaggcaggcacggtggatgaggactcgtcaggctccgaatttctcttctttaacttcctgcattaaccctgggccgtggttcctacgcccgaggctcccttcccttccccagccgcactcatgccctgctcctgtcttgtgctttatcctgccccgctccccatcgcctgcccgcagcagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgcctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgtgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctcccccgtcttctcccctcagcaattcctgcaaagggttaaaaatttaactggtttttactactgatgacttgatttaaaaaaaatacaaagatgctggatgctaacttggtactaaccatcagattgtacagtttggttgttgctgtaaatagggtagcgttttgttgttgttgttttttcatgccccatactactgaataaactagttctgtgcgggtacagca

SEQ ID NO: 16 - DNA, 3074 bp, Homo sapiens
aacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcggaaaaaaaaaaaaaaaaaaaaaaaaaaaaaaaaaaaaaaaaaa

SEQ ID NO: 17 - DNA, 3486 bp, Homo sapiens
cggtagcccagtcgagatggaggaagatgcgaccggcagacggcattcgctgggaacgacggatagactgggggctgcggcctagaggtccgggcttggagttcgcctcagacgcggtggagccgccggagtctgagaaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactggtggctggtggctcagcctcccttgtggcccagagcatcacagtgcccattgatgtagtctcccagcacctgatgatgcaacgcaagggtgagaaaatgggccgctttcaggtgcgggggaacccagagggacaaggggtagttgcctttggccaaaccaaggacatcatcaggcagatcctgcaggctgatggacttcgcggcttctatcgaggctatgtggcttcactgcttacctatatcccaaacagtgctgtctggtggcccttctatcacttctatgcagagcagctctcctacctgtgtcctaaggagtgccctcacattgtctttcaagctgtctcggggcccctggctgcagccactgcctccatcctcaccaatcccatggatgtcatacgaacccgtgtgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccacttccctgtcccttcagtctcaggagccctaggagagtctaagctggggcatcccctggcccagaggactcccgtggtgggcacagttctaagtggatcaggctgtcttgggtgcactggacttggagcactaccttgagaagtcaggttgagaaagtagttgatctagaaggcaacaagtgggcatgtgttccccagcacattacccaggccagcagagccaaacctaggagagggcagtgggtagattctctgccccaggcagccatgacatacacataaataccccaatcactcagacttacggcaacaagtgttgtctcactatggtgatctctaagatccacatcactggatgcgtagtcatcccagtcatggtaccctgtggaggaatgctggaagaacataaagagcagttcagaaagtcacccaataccaggaccactgcatttaccagcctgatactgccaagattatctgatgctctcctcaggagctaggagaggagtgctccttcctccctaccgctactctccccaagcctgtgttgcaggtagagaggtgcagcaaatagagaaggcatgtcaaaccctgcatttctacctgagacgtgtgacctggatgatcctccaaaccctattggtcccaccccctgggaaaggccatggtgccagtttgaaaggtgctagctacctgaagccttgatatttcttcatggctgccgcacattcttccaccttggccagaacaggttctgaaaaccacttctctaccttcaccaccaccactgcccatcttgatctctttgagggttttcccatttcacttgatcttatttttgtttatcccttcctgcactttgtcaagagagtcctccagtttctatccaggaatgttcacatccaaagggttggacccacggatcattctgaatcttcctgcccctcctcactgcttaaccctgagaaccacaaatataatggaagcagttccccccaccctcaccccatctctttaagctcatcctagcaagacctctagagaccctagagactcgactttagtccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccgaaaaaaaaaaaaaaaaaaaaaa

SEQ ID NO: 18 - DNA, 1691 bp, Homo sapiens
tgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcatagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgc

SEQ ID NO: 19 - DNA, 4953 bp, Homo sapiens
gaacgagtgggaacgtagctggtcgcagagggcaccagcggctgcaggacttcaccaagggaccctgaggctcgtgagcagggacccgcggtgcgggttatgctgggggctcagatcaccgtagacaactggacactcaggaccacgccatggaggagctgcaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccagcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattgcgtattttctaagagttttcaacatagtttggcttcacacacaacttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcgagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttgga

SEQ ID NO: 20 - DNA, 2889 bp, Homo sapiens
attcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcaataaatgttatcagccagtcttccaaaatggtcataaactttataaactgctttgggtaaactgagcagaaggtgatacacagaagggaaaatgtgcactcatgctagtgtgaatttggtaagttgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaaaaaaaaaaaaaaaaa

SEQ ID NO: 21 - DNA, 556 bp, Homo sapiens
acaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgctgcctttcccatctgtctatctatctggctggcagggaaggaaagaacttgcatgttggtgaaggaagaagtggggtggaagaagtggggtgggacgacagtgaaatctagagtaaaaccaagctggcccaagtgtcctgcaggctgtaatgcagtttaatcagagtgccattttttttt

SEQ ID NO: 22 - DNA, 3128 bp, Homo sapiens
gcttcgccccgtggcgcggtttgaaattttgcggggctcaacggctcgcggagcggctacgcggagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaagaaaaaaaaaaaaaaaa

SEQ ID NO: 23 - DNA, 3859 bp, Homo sapiens
gtgatctgcgggttgctggggagaggcgcggagaggcgggcgagagtccgcagggcaggcgctgattggctgaggtgggagcagcttcccttccgatgattcggctcttctcggctcagtctcagcgaagcgtctgcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggagcctgagtcctgggccctgtgcctgcttcttttcctgggaacagccttgggctacccaccactcccaaggcattcttccaaatgtgaaatcctggaagtaagattgcaccttcttcctctcctgatcaacatcggtatgatgtctcctgttgcctcaccctttgtctgcagtatcactggataggactggtggaaagggagcagcctgacagagctccaaatgtggagaatatggcatccctccacctatatttgatgtggacggtaaggctaggcctgcaggatcccttatcctgaccaaagactgtgttggggtgccatttgaaaatcgcagggttgcaaaagaatacaatcttacttgcaggtggatattctctatactctcttttaatgcatctaaaaatcccaaacatcccctggttggtgatcacttacagttgtgtccacctttattttatgtactttgattaaaaaaaaaaaactttttgttaatat

SEQ ID NO: 24 - DNA, 6948 bp, Homo sapiens
tccagcaggcctgcttctggagttgggagatgtcagcctgctgggagggggtggggggaggaggaagaggtggggctctactctgattaattaccttaggcattcaggggtggggcttccttcagccatctgcctgagatatgggagggagctggagaaagaaggagggggagagactgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcaagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaaaaaaaaa

SEQ ID NO: 25 - DNA, 6895 bp, Homo sapiens
tccagtcacgccggaagcgcgggcggagcgcacgggtccggggagagtcgcctgcgcccgcgagggggacccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcacaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttagaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccccgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaagcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattaccgagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttcaaaaaaaaaaaaaaaa

SEQ ID NO: 26 - DNA, 2618 bp, Homo sapiens
gtcagccagaaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggatggagccgcctgacgggccgccgccgccgccccagcagcagccgccgcccccgccgcaaccaccccagccagcgccgcaggccacctcgtgctctttcgcgcagaacatcaaagaagagagctcctactgcctctacgactcggcggacaaatgccccaaagtctcggccaccgccgccgaactggctcccttcccgcggggcccgccgcccgacggctgcgccctgggcacctccagcggggtgccagtgcctggctacttccgcctttctcaggcctacggcaccgccaagggctatggcagcggcggcggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagtttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaacctataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaattttaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27 - DNA, 1849 bp, Homo sapiens
agagtccccggagccgcgagctgggagcgctgtgccgggagccgggagccgagcgcgccgggctggggccggggccggagcggagcggagagggagcgcgcccgccccagccccgagtcccgccgccttccctcccgccgcagcgcgggcccaccggccgccgccccagccatggagcaagacaacagcccccgaaagatccagttcacggtcccgctgctggagccgcaccttgaccccgaggcggcggagcagattcggaggcgccgccccacccctgccaccctcgtgctgaccagtgaccagtcatccccagagatagatgaagaccggatccccaacccacatctcaagtccactttggcaatgtctccacggcaacggaagaagatgacaaggatcacacccacaatgaaagagctccagatgatggttgaacatcacctggggcaacagcagcaaggagaggaacctgagggggccgctgagagcacaggaacccaggagtcccgcccacctgggatcccagacacagaagtggagtcaaggctgggcacctctgggacagcaaaaaaaactgcagaatgcatccctaaaactcacgagagaggcagtaaggaacccagcacaaaagaaccctcaacccatataccaccactggattccaagggagccaactcggtctgagagaggaggaggtatcttgggatcaagactgcagtttgggaatgcatggacaccggatttgtttcttattccttcacttttggggaaaatctcttgtttttaaaaagtgataaatttggtgttaggtccttggcactttccttcttttccaactgggagaatcctttctccctgccttcttgccctgccctctctgtagcccccaccctcctgccaagctgcctctgggaaggaagaaacaggagctaggcagaagccttgagcagggaagagttcttcccttagccctgactttacttgctgtgggaagagagatgagggtcagataggtgggaggactaacttccagggtgccaagaaggaagaaaagccccaggttctcttttcttattgaggaacgatccgaccacctcacaggcctgccctgcagctggaagactcggcgctctaaggcctgtgccgtgtccagctgtgactgtgcggtgggctccatctgctggacaaaaggggaactgcaccatggcacttggcccatgggaaagagggtatggtggtgtgccgatacctcctcgcctgccctccaagccccagctgccttccttttggattcccaagcttcaggatgtgttccctcttccagctgtgggaccgctgtcccttatttcaacccgttagcaacaatggatagagaacacagtggctattaatgaagaggcccatgctggagactggaagggttcccttgtcctagacattgaggggcccagataagaccaaaaccaagcataagagaagaaactgtctcagatctcacggccaggcctctctcctgctgctgtttttgattttcccaggtagtgggagagaggaaaggagggaaggcaagattctttccccctccctgctgaagcatgtggtacagaggcaagagcagagcctgagaagcgtcaggtcccacttctgccatgcagctactatgagccctcggggcctcctcctgggcctcagcttgcccagatacatacctaaatatatatatatatatatatgagggagaacgcctcacccagattttatcatgctggaaagagtgtatgtatgtgaagatgcttggtcaacttgtacccagtgaacacacacagtcaggaaaaaaaaaaaaaaa

SEQ ID NO: 28 - DNA, 7488 bp, Homo sapiens
atgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgttgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacatgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcaaaaaaaaaaaaaaaaaaaaaaaaaaaaaa

SEQ ID NO: 29 - DNA, 5334 bp, Homo sapiens
cccacgccgcgccttccggttggtccttgaggcgacgggtgaggcacagctgagcgccaaagccacaggctggggcgctaacgcccccgctcagcgctctgcgctccagacagctgcgagctggagtaggaaggttcaggcggtggcggagagtgcgctggaggctggagggccaggaggcgggaagcttcccgcacgggggcgctgtcacctgcctgtgggaggagccagagagggacctggctctgctgctctgaagcaccggagtcgggagaacccatccagacatgaagagcgccaaaggtattgagaacttggcttttgtcccctccagcccagacatcctgcgccgcttgtctgcgtcgccctcccaaatcgaagtctctgccttgtcctctgacccccaaagagagaattctcagccacaggagcttcagaagccccaggagccccagaagtcaccagagccatctctgccttcagcccctcccaatgtctccgaagagaagctccggtcactgtcgctgtccgagtttgaggaggggtcttacggctggaggaacttccatcctcaatgtctccagcgctgcaacacacctggaggctttctgcttcactactgcctcttggccgtcacgcaaggtattgtagttaatggcctagtaaatattagcatttccactgttgagaagcgttatgaaatgaagagttccctgactggcctgatttcatcaagctacgatatttcattctgtttgttgtctttatttgtatcattctttggtgaaagaggacataagccgagatggcttgcatttgcagcctttatgattggactgggagcacttgtattctcattgccacaatttttcagtggagaatataaattggggtctctttttgaagacacttgtgtaacaacaaggaatagcaccagttgtacatcttcaacttcttcactttctaactacttgtatgtcttcatcttgggacaactattgctgggggcaggaggaactcctctttatactctgggaacagcctttcttgatgattctgtgcccacacacaagtcttctctctatataggaaccggttatgctatgtcaatcttaggccctgctattggctatgtattgggaggacaactgctaaccatatacattgatgttgctatgggagaaagcactgatgtcactgaggatgatccgcgatggttgggagcttggtggattgggtttcttctatcatggatctttgcttggtctttaataatacctttttcttgctttccaaaacatttaccaggtacagcagaaattcaagctggaaaaacttcccaggctcatcagagtaatagtaatgcagatgtgaaatttggaaaaagtattaaagattttccagctgctctaaagaatttgatgaagaatgctgtctttatgtgtttagttctatcaacttcttcagaagccttaattactactggatttgctacatttttacctaaatttatagaaaatcaattcggattgacatccagcttcgcagctactcttggaggggctgttttaattcctggagctgctctcggtcaaattttaggtggcttccttgtttcaaaattcagaatgacatgtaaaaacacaatgaagtttgcactgttcacatctggagttgcacttacgctgagttttgtatttatgtatgccaaatgtgaaaatgagccatttgctggtgtatctgaatcatataatgggactggagaattgggaaacttgatagccccttgtaatgccaattgtaactgttcgcgatcatattattatcctgtctgtggagatggagtccaatatttttctccctgctttgcaggctgttcaaacccagttgcacacaggaagccaaaggtatattacaactgttcctgtattgaaaggaaaacagaaataacatccactgcagaaacttttggttttgaagctaaagctggaaaatgtgaaactcattgtgcgaaactgcccatattcctttgcattttctttattgtaattatttttacctttatggccggtactcctataactgtgtctatcctaaggtgtgttaatcacagacaacggtccctagccttgggaatacaatttatggtccttcgattattagggacaattcctggaccaattatatttggtttcacaatagacagcacatgtattctttgggatataaatgattgtggaattaaaggagcttgctggatttatgataacatcaagatggcccatatgctagtagccataagtgttacttgtaaagttatcaccatgttcttcaatggatttgcaatctttttgtataaaccacctccatcagccacagatgtgtcatttcataaagagaatgcagttgtgactaatgttttagcagaacaggatctcaacaaaatagtaaaagaagggtgaaatgggaaaagagaagactgttttacacctggaaaatttacctcgatttttaagaacacacattgccatggcaggattatctatccaatatggacaatcatatttacaaaattgatgtttttataatcaaatgtatttttttacttatgtagtttttgttttatgcaagaaacagacctgtgccttcaaagcccacgtaaagcctcaaaacacagcacacacacacacgagcacacacacacacacacacacgaacacacacacacacacacacacgcacacatacacacttatttcctattcccattgtctaggtatgaaatcctcaagcaataacaagaaaaaaggcccacaattagaaaaatttacatttaaaaaaaatgttgtttctatccccattacaacttgtttaattttaattttcattgtcaatattttgagcttagaacatttatggtataaaaatttaaactaatcaaagttgtgtgatgatttccgggaattattattgaaagcctatgaatttaaaaccaggtttaccatgtaatttgtttttaaatttatgtatactagcctggcctttctccaagcaaattattgaactattagaatatgttagttatcatccttgtgtcttagtatatagtgaatacagaaacatcagcattgtatacacatattttcactttaactcaagaattccaggaggtaatttgttgatattacaatttttaacacatttatgattctgtgataatattattcaattgcatatatttcagaggaaagtaccagtcagtaaagaaaaatgccaactaaacatgaaactattgatcaatacttatatacctttaatttttcctatttgaaaagccaaccacttaacacattactcatagcacctaagacagtgccttgcatagtgtagtcatctattattattgtttaattagaatattaaaccctaccctttaactcagcagtccccaaccttttttgcatcagggaccatttttgtggaagacaatttttccatgggggaagaaggtatggttttgagatgaaactgctccacctcagaccatcaggcattagttagattctcataaggagagtgcaacctagatcccttgcatgtgcagttcccaatggagtgtgcactcctatgagaatctaatgccactactgatctaacaagaggtggagctcaggcagtaatgctcactcacctgcctctcagctcaccaactgtgtggcccgattcctaacaggccacacacagcccagggctggggacccctgctttaactgatgcattgatttgataaagtattttacaagcctgataatgttataaccctgtttattcaggtcagatttatgccaactttgctgagaatatggagggtatagatgagtgaacatcaacaaacataacttctaccatggttaagaattttacttaggaaaagtattgaagttcaaatccagatagtattacatttgaaattgttataagggttattaatttaataaaattcatcatcaggtttcccctataagctttctcctaggttaattttccacaagcattgttttatatacactgtaatcaggataacacaagcttagtgttagatcttgtaggaaaccaagattagaaacattagaaatttgcagaatttaagaaattatgttttgtggtaatctatggccaacgatgttagaacctagcgcaattgtaaagtgaaattcaaggagaaggaatgaggagttagggaagcagcatacttgaatattagagaaggagaggagctgtgggtcaggaatcagagagacctgctaaaaccagacagatataaacaccaaagacggaagccaaataggtagccaaaaatccagatatttgagaagcaggaaatttatagcaaccaaagaaatagggcaagagaggcaggtgaacacacatgatacctcaattgacaatcttcctcccaccaagccagacacgttgtaaatgctgcttcctattggagcccagaaaaaaggaaaaggaaagtttaggctttctttgtcctttgtgtggaagcagggaattggattgaagactttcatagttgtaacataaaggcaaatcctgaggaactcactgatggagatgtgaaatggcagtaaggaagaaaacagaataactgaacaaatatattagtctagggccacttaatttagaggaagaaaaaaaatcaacccatccatagaaatagtttgataaacaggtcactaaatcattggcgtttataaagattcttagctatcaagggctgcattgtattttatatactcagttttataaggtgatactttttaaataagcgctttaatgaaaatggttagactgaaaataattttggtccttaaaaggagtcaggagcttttatatataaggtacatattttaaaagaatacctcctttataacagggttttacagacactaccataatttataatcattattttttacttttgggttcacctagatcatatgagttgatgtgatacttctagaacaaaattattcatagtgcgttttttgtaatttatgattgttaagtaagcttgacttataaattgacattgtaattgtgtacataattggatatatgtgttaaaatttaacatttagatttacttaattgtagaaaatacaaatgtaaaacttacacatggaaagaactgtatgcagttgactttactatgtaaattggagggaaacaaagttttagatccattttctttcaaaattttctttattgtaaagtatgcaaaatatatattcataccatttattaaatcagaatgtttatacaaaa

SEQ ID NO: 30 - DNA, 3143 bp, Homo sapiens
ctataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtgattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttttttgtgccatgcgtaaggtgagtcaaaccaaacctcattgataatctcccctttggtttcctttgaaagtaaattggtatcttgtagttttgtgcacacgaaaggagagaaagtttctccagtaaagagtacgaactagtaattttggggggtctctctaattctggtattttgacatgttataatacgcaagtaaaataaaacaatagtttactcagctcatgttactattccccaacagatattgtggcaaatcacacataggaaagaggatttgggaatacagtagcaaaacataaattaaaactcaaatgcccaggacaaaataaaacaatataccagatggagaggatgcccgtattttcatcttccattctaacattatccattgttagatgcataagcattttgatattgtgtaataaatgtggtatttgagaagataaatgatgtagttgatcagtaatcctcctctatcacctttttagactttgtaaggtaaatatttggactaacttttagaaaagtttccctttttttctccatttacatttttctggtttttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaattttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtgttcttgaggttcatctgttgtagtatgtattgatacttaggatttttttattgccgaatactattccattgcatggaaaagacctattttatttctaggttcaccagttgagggacatttggattgttcccacttcttgggctgttaggaataatgttgctctgaacatgtaaataaagatctttgtgttcacatatgtttttcattttctgttggggagattccctaggctagaaattgctgggccatatgaaaaatcaatagttagctttgtaagaaacagtcaaactgttttcccaacgtgacattttatattcccaccaggaatgtttaaaactagtgtcttcaaatcctcaccaacatccaggattgtgtctttatgattatagccatttttgtaggtacaaagtggcatctcatggtggttttaatttgcatttccataatatctaattaggttgagctttttttatgtgcttattggccatttgtttgactttgtttggtgaaatgtatacaaatcatttgctcatttttaatttgggttgtctgtcttgtcttctcattttattgagttaaatgagttcttaataatctctggcttacaagtccttaatttatcaaatatatgatacgtggacatttcctcataaaaaaaaaaaaaaaaaa

SEQ ID NO: 31 - DNA, 3485 bp, Homo sapiens
agtcgcccaggggagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaatcattgtatagactgacatccagttttcttcaactgt

SEQ ID NO: 32 - DNA, 2117 bp, Homo sapiens
gaaccggaagcgtgggtctggcggctgcaccggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggaggcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccaaaaaaaaaaaa

SEQ ID NO: 33 - DNA, 618 bp, Homo sapiens
cttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggt

SEQ ID NO: 34 - DNA, 8181 bp, Homo sapiens
agaaacattgcatctggaaagtccagaacaagttgttaatttcccagcaagcactggagcggatttggaaggaactatgcaatgtagtgggttctttgtgaaagaacagcaatgagcaaagccacaggaacctccgctggggtgcccagaacactggccctgggctagcgacttgcctcagccccatttcccggagaggctgccatgaagaggaagccggcggagtcttggtgctgagtctgagggcttcaggcaggacccaagactctcctctgaggtagcagcccccagagaaggttagctgttctctgatgaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtcggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttagtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagtt

SEQ ID NO: 35 - DNA, 2819 bp, Homo sapiens
ctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggccctctctccagcccctacgaccatggactttaccccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacaggtggtcggtgtgggctgcgtcctggatggggtgcgctacaacaacggccagtccttccagcctaactgcaagtacaactgcacgtgcatcgacggcgcggtgggctgcacaccactgtgcctccgagtgcgccccccgcgtctctggtgcccccacccgcggcgcgtgagcatacctggccactgctgtgagcagtgggtatgtgaggacgacgccaagaggccacgcaagaccgcaccccgtgacacaggagccttcgatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttctttagatgccaaaccacaagactctttgggtccattcagatgaatagatggaatttggaacaatagaataatctattatttggagcctgccaagaggtactgtaatgggtaattctgacgtcagcgcaccaaaactatcctgattccaaatatgtatgcacctcaaggtcatcaaacatttgccaagtgagttgaatagttgcttaattttgatttttaatggaaagttgtatccattaacctgggcattgttgaggttaagtttctcttcacccctacactgtgaagggtacagattaggtttgtcccagtcagaaataaaatttgataaacattcctgttgatgggaaaagcccccagttaatactccagagacagggaaaggtcagcccgtttcagaaggaccaattgactctcacactgaatcagctgctgactggcagggctttgggcagttggccaggctcttccttgaatcttctcccttgtcctgcttggggttcataggaattggtaaggcctctggactggcctgtctggcccctgagagtggtgccctggaacactcctctactcttacagagccttgagagacccagctgcagaccatgccagacccactgaaatgaccaagacaggttcaggtaggggtgtgggtcaaaccaagaagtgggtgcccttggtagcagcctggggtgacctctagagctggaggctgtgggactccaggggcccccgtgttcaggacacatctattgcagagactcatttcacagcctttcgttctgctgaccaaatggccagttttctggtaggaagatggaggtttaccggttgtttagaaacagaaatagacttaataaaggtttaaagctgaagaggttgaagctaaaaggaaaaggttgttgttaatgaatatcaggctattatttattgtattaggaaaatataatatttactgttagaattcttttatttagggccttttctgtgccagacattgctctcagtgctttgcatgtattagctcactgaatcttcacgacaatgttgagaagttcccattattatttctgttcttacaaatgtgaaacggaagctcatagaggtgagaaaactcaaccagagtcacccagttggtgactgggaaagttaggattcagatcgaaattggactgtctttataacccatattttccccctgtttttagagcttccaaatgtgtcagaataggaaaacattgcaataaatggcttgattttttaaaaaaaaaaaaaaaaaaaaaaa

SEQ ID NO: 36 - DNA, 3397 bp, Homo sapiens
tatgaggcgcccaccatggtgcgatgcgaccgcgggctgcagatgctgctgaccacggccggagccttcgccgccttctcgctcatggccatcgccatcggcaccgactactggctgtactccagcgcgcacatctgcaacggcaccaacctgaccatggacgacgggcccccgccccgccgcgcccgcggcgacctcacccactctggtctgtggcgggtgtgctgcatcgaagggatctataaagggcactgcttccggatcaatcacttcccagaggacaatgactacgaccacgacagctcggagtacctcctccgcatcgtgcgagcctccagcgtcttccccatcctcagcaccatcctgctcctgctgggtggcctgtgcatcggtgctggcaggatctacagccgcaagaacaacatcgtcctcagtgccggcatcctcttcgtggctgcaggcctcagtaacatcatcggtatcatcgtctacatttccagcaacacaggtgacccgagtgacaagcgggacgaagacaaaaagaaccattacaactacggctggtctttttactttggagctctgtctttcattgtggctgagaccgtgggcgtcctggctgtaaacatttacattgagaaaaataaagagttgaggtttaagaccaaacgggaattccttaaggcgtcttcctcttctccttatgccaggatgccgagctacaggtaccggcgacggcgctcgaggtccagctcaaggtccaccgaggcctcgccctccagggacgtgtcgcccatgggcctgaagatcacaggggccatccccatgggggagctgtccatgtacacgctgtccagggagcccctcaaggtgaccaccgcagccagctacagccccgaccaggaggccagcttcctgcaggtgcatgactttttccagcaggacctgaaggaaggtttccacgtcagcatgctgaaccgacggacgacccctgtgtgagccgcctgccctttctctccgctccagcctctccccagaacggctctttttgtcacacaggatggcatgtgatcctcaagacgacgaacaatgaactaaagccaaatgcagccctccctggcctccagaggtggcgtgggctggctttgcacgaaggttgtgctgggagaccggacccggggctgcagaagaagctgaaggctgactttgtcccctccccgaaaaagggtgttttgatgcctcagggtctctgaaatctcccgggaagccccagagctttcctgaggctgcctggccttgatcaacttgggaagacaaaattgagccattatctcctcttggaaacgaatcttgccagaaaaacgggatttcagggccttccctccctgcctgggtgtcgggccaccagaaggctctgccggacgccaagaagacggtctctgggctcttgtcagctgcttttgaacctgaggttcctgcgtcgttgagccagaaatcagaccaccgaagctcactcccttcctctccatctctccctctctccaagactctggcagtggcctatgatcctgaagacagctctgcagccaactggtgctttggcctttgcgctgtcccggggccagcttccctcgacctggggaggccgtggcctgtggaggaggcccaggtaaaggctgggggctgttgctggctatcctctttgcttctggaagtttctgcctcactcagaatgggcaggacagacccactgactggacttcagagtctggagggttccatcggtcaggggaatggcggccacgtgacctcttgccgtgccccttgtcatagacccaaggagcaactctgtcccctgagcgttgggggtcccgggggagaggtggacagacacctccctccaactggcatttggcaacaggagcctggacttctgtgcaagaaagggagacctaagggtgaacagtggccaataaaaaccctagagaacaaacatccatttcctaggtggttacaaatcataacttcctgcaaatcaacgccaggagagcaacttaccttcatttctttgtcttaaaaagtagcagcaactggccccacaactcctgtcattgtaagttattctgccaccacctaacaggacggagtggagtgagtttggataaacggaccgagctgggcttctcttcctccctacagaggggagatctcagcactttgtccggagctgaggaagtggtttctgtgttttacagtttttccagccattcttttcttccccctcctgaagcaagcaaagagcgtggaggcgtgtgcaggcttggaagaagaactctccagaacatggaacttaaccctcttttgtataaaacatgtgctttctaaagaaaaattgtttcttattttttgagactccttgatccaccctggaacagtcgcctgtagtcctggtagctgttgtgcttggaaataacgagcgcatccttgcctcagctacctgctcacagcccatgggtggactcggccccctggggttcagacccaggtccgttcggcctagtgatgatgtcatcgtccatcccatcttcctttgcccccaggaaaggacgcatccaccggtagcggccccagctgactgtcgccgtgtgctggggatctgaaatgaggcctgccagggcccctgtgtgctgtgctccagagccttcgctcccatcagggttggcatcatctgatggcatgtccaagtgtgcccagcagcggatgctgaagcaccagagctcaaggccttcacctgctctaggccagccctgtcaccacctccactgccatgaccaggccgaaggcagggaacgccctccccagtcccgctgtccagcaaggccccgagacttttcttctgtgatttccaaaagcaaggcagccgtgctgttctagttcctctccatccgccacctcccctcccgctgccccagaagtttctatcattccatggagaaagctgtgttccaatgaatcctacctcttgcccagtcccaggcagagtaagcagggcccacctagggaccaagaaagagtaggaagaaggggacgagccgggagcaaaaccacctcagacacccgggccttctcagccttctccccgcggccagctgggtctccggggaccctgggccctgggccgcccattcctggccctcccgctgcatctcagacctgacacccaacggggggatgtggtggcctgtgcccaccttctctccctcctcccgacccgccccctcgcccccacccctgtgtgtttcgccagttaagcacctgtgactccagtacctactactggttttgggttggttgttctgtcttttttttaattaaataaaaacatttttaaaatgtt

SEQ ID NO: 37 - DNA, 510 bp, Homo sapiens
tgaggctgccttataaagcaccaagaggctgccagtgggacattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatga

SEQ ID NO: 38 - DNA, 1703 bp, Homo sapiens
cgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaatttta

SEQ ID NO: 39 - DNA, 1835 bp, Homo sapiens
ctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctggtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaaaaaaaaaaaaa

SEQ ID NO: 40 - DNA, 1717 bp, Homo sapiens
gcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtgagtgagtgggggcgtgcttgggaggcgcaggatggcaccggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctaaaaaaaaaaaaaaaaaaaaaaaaa

SEQ ID NO: 41 - DNA, 1987 bp, Homo sapiens
cggaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcacagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaattggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggaaaaaaaaaaaaaaaaaaa

SEQ ID NO: 42 - DNA, 1099 bp, Homo sapiens
tcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatttgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattatcaattaactgaaaaaaaaaaaaaaaaaaaaaaaaaaaaaaa

SEQ ID NO: 43 - DNA, 4597 bp, Homo sapiens
gtccttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaatgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaat

SEQ ID NO: 44 - DNA, 1149 bp, Homo sapiens
ccgcagccatgaccccgcagcttctcctggcccttgtcctctgggccagctgcccgccctgcagtggaaggaaagggcccccagcagctctgacactgccccgggtgcaatgccgagcctctcggtacccgatcgccgtggattgctcctggaccctgccgcctgctccaaactccaccagccccgtgtccttcattgccacgtacaggctcggcatggctgcccggggccacagctggccctgcctgcagcagacgccaacgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccagctacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacgtccaagtggcggctcaggacctcacagactacggggaactgagtgactggagtctccccgccactgccacaatgagcctgggcaagtagcaagggcttcccgctgcctccagacagcacctgggtcctcgccaccctaagccccgggacacctgttggagggcggatgggatctgcctagcctgggctggagtccttgctttgctgctgctgagctgccgggcaacctcagatgaccgacttttccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactgggaagccgacgtgggagggtagcttgaggccaggagctcgaaaccagtccgggccacacagcaagaccccatctctaaaaaattaatataaatataaaataaaaaaaaaaaaaa

SEQ ID NO: 45 - DNA, 3365 bp, Homo sapiens
agcatccggagcggagctgcagcagcgccgccttttgtgctgcggccgcggagcccccgagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccatgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggaatagcaaaccacgaaatcgcccatcattccgacagatcctgctgcatctggacattgcctcagctgatgtactctccacaccccaggagacttactttaagtcccaggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaaggcccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatatggattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaaagccagggttgtctttatattctttatccccaaataatagggggtggggggaggggcggtgggaggggcaggagagaaaaccacttagactgcacttttctgttccgtttactctgtttacacattttgcacttgggaggagggaggctaaggctgggtcctcccctctgaggtttctcaggtggcaatgtaactcatttttttgtcccaccatttatcttctctgcccaagccctgtcttaaggcccagggggaggttaggagactgatagcatgtgatggctcaggctgaagaaccggggtgctgtttaagtccctgcttttatcctggtgcctgattggggtggggactgtcctactgtaacccctgtgaaaaaccttgaaatataacactccatgcagga

SEQ ID NO: 46 - DNA, 12227 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaactagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccaaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacac

SEQ ID NO: 47 - DNA, 3561 bp, Homo sapiens
ccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctacctccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaacatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatca

SEQ ID NO: 48 - DNA, 2520 bp, Homo sapiens
  misc_feature (2509)..(2509): n is a, c, g, or t
gctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcatatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccagggcctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccttattatggagatgaaccaatggatttcaaaatcaacaccgatgagattatgacttcactcaagtctgctaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaacagtgcaaggtggaccgacaaaattccagttattatttccaaatgtttggaaacagtataatttgacaaagaaaaatgatagttcccttttttgctgttccaccaaatacaattcaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcatgattaatctcctggaagattggtttaaaagaaagtgtaatgcaagaattaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcaccggcatgccacaggggattctcctccttcatcctgtaaaggtcaacaataaaaaccaaattatggggctgcttttgtcacactagcataggagaatgtgttgaaatttaactttgtaagcttgtatgtggttgttgatcttttttttccttacagacaaccataataaaatatanattaaaattca

SEQ ID NO: 49 - DNA, 674 bp, Homo sapiens
ccccttggttccgcccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatccttaaaaaaaaaaaaaaaaa

SEQ ID NO: 50 - DNA, 1002 bp, Homo sapiens
tcaccagatcccagaggctgaacacctcgaccttctctgcacagcagatgatccctgagcagctgaagaccagaaaagccactaagactttctgcttaattcaggagcttagaggattcttcaaagagtgtgtccagcatcctttgaagcatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggctgtaccaaggtccctgagccaggttgtaccaaggtccctgagccaggctgtaccaaggtccctgagccaggttgtaccaaggtccctgagccaggctacaccaaggtccctgaaccaggcagcatcaaggtccctgaccaaggcttcatcaagtttcctgagccaggtgccatcaaagttcctgagcaaggatacaccaaagttcctgtgccaggctacacaaagctaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagcacattgtcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctcttccctcattaaattgcttttaattccaaaaaaaaaaaaaaaaa

SEQ ID NO: 51 - DNA, 4950 bp, Homo sapiens
cagagcagggtggagagggcggtgggaggcgtgtgcctgagtgggctctactgccttgttccatattattttgtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcagctaaagaacagtatttcattccaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcacgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccatgtgggactaatgaatgcttcatagtggaaatatttgaaatatattgtaaaatacagaacagacttatttttattatgagaataaagactttttttctgcatttg

SEQ ID NO: 52 - DNA, 2438 bp, Homo sapiens
gcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccccagggtccccgacatcctgagctcagtgaggaggggctcgggagccccagaagccgaggggcccctgccctgcccatctccggctccctttagccccctgccagccccatcccccaggatctctgacatcctgaactctgtgagaaggggttcaggaaccccagaagccgagggccccctctcagcggggcccccgccctgcctgtctccggctctcctaggccccctgtcctccccgtcccccaggatctctgacatcctgaactctgtgaggaggggctcagggaccccagaagccgagggcccctcgccagtggggcccccgccctgcccatctccgactatccctggccccctgcccaccccatcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaa

SEQ ID NO: 53 - DNA, 2195 bp, Homo sapiens
ggctgcaggcggggccggcgggggcgcagcggcccgggaggaagcagtaccttgaagagaaattggagagggagtcaattcctaggatagcagagagatggacaacagacagaatagatggagtttcacaatggtggccatgtgtctggaattggtgggttcttggtctcactgacttcaagaatgaagccgcacaccctcgcagtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttatttttta

SEQ ID NO: 54 - DNA, 5052 bp, Homo sapiens
aagtactgaactcctaatatcaccaattcttctaagttcctggacattgatccggaggaggattcgcagttcaacatcaaggtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagtaccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaatatg

SEQ ID NO: 55 - DNA, 3387 bp, Homo sapiens
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaataatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatataggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcccggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccagagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaa

SEQ ID NO: 56 - DNA, 2390 bp, Homo sapiens
gtggccgtccaggccccgccccgcagcccagccggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgacatgggatggggtgacctcggggtgtatggagagccctccagagagaccccgaatttggaccggatggctgcagaagggctgcttttcccaaacttctattctgccaaccctctgtgctcgccatcgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgaaaagttagggaagtgtctgacacctccagaatccattcccaagaagtgcctctggtcccactagcacctgcgcagactcaggccaggcctagaatctccggttggccctgcaagtgcctggaggaaggatggctctggcctcggtcctcccccaaccctgcccaagccagacagacagcacctgcagacgcagggggactgcacaattccacctgcccaggacctgaccctggcgtgtgcttggccctcctcctcgcccacggcgcctcagatttcaggaccctcctcctcgcccacggcgcctcagacctcaggaccctgccgtctcacgcctttgtgaaccccaaatatctgagaccagtctcagtttattttgccaaggttaaggatgcacctgtgacagcctcaggaggtcctgacaacaggtgcctgaggtggctggggatacagtttgcctttatacatcttagggagacacaagatcagtatgtgtatggcgtacattggttcagtcagccttccactgaatacacgattgagtctggcccagtgaatccgcatttttatgtaaacagtaagggaacggggcaatcatataagcgtttgtctcaggggagccccagagggatgacttccagttccgtctgtcctttgtccacaaggaatttccctggacgctaattatgagggaggcgtgtagcttcttatcattgtaactatgttatttagaaataaaacgggaggcaggtttgcctaattcccagcttgaaaaaaaaaaaaaaaaaa

SEQ ID NO: 57 - DNA, 2618 bp, Homo sapiens
attggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 58 - DNA, 2620 bp, Homo sapiens
ctattggaggagaaggccgagaggagcaggacggcgggaagaggagtgcggaacccgcgggaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcaaaaaaaaaaaaaaaaaaa

SEQ ID NO: 59 - DNA, 1548 bp, Homo sapiens
gacctttcagagccaggagggctttcgggggcgtggggcgcgctgcggagcggagccgcggctcgacggcggtgcgctggcggcgagtgtatgcagacggcgcccggcccgaaccccgagccccgcggggctccccacccgccggcctcccgcccctcccgcgcctccgcctggggaccacgtcggccttttgttggcgaaccgtcctttctttcagcgctttgcgcagcaacggaaatttcattgctcctgggtggaaattaaagggactcgcgttccctctctccctctccctctcccactctccctctctttctctctctcgcccacccttcccccttcttcccccacctttcccgcgaagccggagtcagcatctccaggcgcgggatcccgctccgagcacctcgcagctgtccggctgccgccccttccatgggcgccgcgctcgcctgcagccgccgccgccgcggggcgggcgcgatgccacgatgggcctaatctggctgctactgctcagcctgctggagcccggctggcccgcagcgggccctggggcgcggttgcggcgcgatgcgggcggccgtggcggcgtctacgagcaccttggcggggcgccccggcgccgcaagctctactgcgccacgaagtaccacctccagctgcacccgagcggccgcgtcaacggcagcctggagaacagcgcctacagtattttggagataacggcagtggaggtgggcattgtggccatcaggggtctcttctccgggcggtacctggccatgaacaagaggggacgactctatgcttcggagcactacagcgccgagtgcgagtttgtggagcggatccacgagctgggctataatacgtatgcctcccggctgtaccggacggtgtctagtacgcctggggcccgccggcagcccagcgccgagagactgtggtacgtgtctgtgaacggcaagggccggccccgcaggggcttcaagacccgccgcacacagaagtcctccctgttcctgccccgcgtgctggaccacagggaccacgagatggtgcggcagctacagagtgggctgcccagaccccctggtaagggggtccagccccgacggcggcggcagaagcagagcccggataacctggagccctctcacgttcaggcttcgagactgggctcccagctggaggccagtgcgcactagctgggcctggtggccaccgccagagctcctggcgacatcttggcgtggcagcctcttgactctgactctcctccttgagcccttgcccctgcgtcccgcgtctgggttctcagctatttccagagccagctcaaatcagggtccagtgggaactgaagagggcccaagtcggagctcggagggggctgcctgcaatgcagggcatttgtgggtctgtgtggcaggaagccggcagggaagggcctgagtgccagccctggcagactgaggagcctcccaggagcagcggggcagtgtggggctttgtgtcatcacaacattaaagtattttattcta

SEQ ID NO: 60 - DNA, 2782 bp, Homo sapiens
cgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttaaaaaaaaaaaaaaaaa

SEQ ID NO: 61 - DNA, 3234 bp, Homo sapiens
cttgcccagactcaacatggcggctacacgtcgcctgtcagtctgtgaagcctaccccgggcgtgggccgcagcgtcgagtaacgtcattcgaaccccgtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaaaaaaaaaaaaaaaaaaaaaaaaaaaaaaaaaaaaaaaa

SEQ ID NO: 62 - DNA, 2454 bp, Homo sapiens
ttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaaca

SEQ ID NO: 63 - DNA, 70 bp, Homo sapiens
cggctaattttgtatttttagtagagatggggtttcaccatgttggccaggctggtcttgaacccctgag

SEQ ID NO: 64 - DNA, 70 bp, Homo sapiens
gcctcagcttcctgagtagatgggattacaggcgcctgccaccacgcccagctaatttttttgtattctt

SEQ ID NO: 65 - DNA, 70 bp, Homo sapiens
gagtatctattatagtgggagcacctactacaacccgtccctcaagagtcgagtcaccatatccgtagac

SEQ ID NO: 66 - DNA, 69 bp, Homo sapiens
ggtttggggaggtgcatggaggaagaggatggtttcccaaatcttatgtcaagatcattcctgggagtg

SEQ ID NO: 67 - DNA, 69 bp, Homo sapiens
ttggcagcttggggcaccctgaattagcaaaaatggggggtgatgaggtgctgaagaaggatacttaac

SEQ ID NO: 68 - DNA, 70 bp, Homo sapiens
ttaggggcctttccaagattgctgtttttgttttggagcttcaagactttgcatttcctagtatttctgt

SEQ ID NO: 69 - DNA, 70 bp, Homo sapiens
tgttcgtcttttctgtccattgattctcagcctcaggcatccaacgcactggaggagctttgctttatga

SEQ ID NO: 70 - DNA, 69 bp, Homo sapiens
gtgtgtgcatgacaactcgtgtgtatgagaaggagggatatgaaggaagatggcttgcagagtaagtcg

SEQ ID NO: 71 - DNA, 70 bp, Homo sapiens
tggaatgaagatggagactcttttgcctgaagcaacgatggagcagtgaccctctaatcaactcggtggc

SEQ ID NO: 72 - DNA, 69 bp, Homo sapiens
gaagtccaaactggactgggagagcttcaaggaggaagaggggattggtgaagaactggccatccataa

SEQ ID NO: 73 - DNA, 70 bp, Homo sapiens
tccaggacatgtttgcactacttgggggagtttggagaagaccagatctatgaagcccaccaacaaggcc

SEQ ID NO: 74 - DNA, 70 bp, Homo sapiens
acctttggacatcggtggtgctgaccatgaattctttgtggacattggcccagtctgtttcaaataaatg

SEQ ID NO: 75 - DNA, 70 bp, Homo sapiens
tgagttcgtcaagaggcctgggggtcagcacggaggggactggagctggagagtgactgtagagcctcag

SEQ ID NO: 76 - DNA, 69 bp, Homo sapiens
gagccgctagtgaaaatctggcatgaaataaggactaatggccccaaaaaaggaggtggctctaagtaa

SEQ ID NO: 77 - DNA, 70 bp, Homo sapiens
accagtctgtgtgtacccgcaagcccagtgccccccatggctatacctgcgagtgtcccccaaattacct

SEQ ID NO: 78 - DNA, 70 bp, Homo sapiens
aatgcttcctggagtccttcaacagtttgggctgaaaagcattattggcatgggaacaggagcaggcgcc

SEQ ID NO: 79 - DNA, 69 bp, Homo sapiens
cagttccccccaccctcaccccatctctttaagctcatcctagcaagacctctagagaccctagagact

SEQ ID NO: 80 - DNA, 69 bp, Homo sapiens
ttctataatgtgggaaatggcttggggaggatggcccctagcttaggaagactgttgtgttatttgttc

SEQ ID NO: 81 - DNA, 69 bp, Homo sapiens
tttgtctttgaacgtacccaaggtcacatagctgggatttgaactgagccgtgcagctgggatttgaac

SEQ ID NO: 82 - DNA, 70 bp, Homo sapiens
cctacccctcccacttcaatccagcaatttccaccactttgatgtctgggtacccatttttaggagctct

SEQ ID NO: 83 - DNA, 70 bp, Homo sapiens
tcacatcaaagaactactgacaacgaaggccgcgctgcctttcccatctgtctatctatctggctggcag

SEQ ID NO: 84 - DNA, 70 bp, Homo sapiens
gagtttgcgaaggatccgtccctctctgacagttccactgttgggcttcagcgagaactttcaaaggctt

SEQ ID NO: 85 - DNA, 70 bp, Homo sapiens
ctatccaacctgggtaggtgggtaggggccacagttgctggatgtttatatagagagtaggttgatttat

SEQ ID NO: 86 - DNA, 70 bp, Homo sapiens
ttactcaggaaaacggtagatcaattcagccatggtagtgctggttggcagggattggtaacggagagaa

SEQ ID NO: 87 - DNA, 70 bp, Homo sapiens
tgaaagattgagccaaattctgttgtcagttctaagcatgcagttctcacctccatttagtcccccatca

SEQ ID NO: 88 - DNA, 69 bp, Homo sapiens
gctttctgaaattcacagaagcctaggaggactggggtaagcggaataaactagagaagggagacattg

SEQ ID NO: 89 - DNA, 70 bp, Homo sapiens
gaagagttcttcccttagccctgactttacttgctgtgggaagagagatgagggtcagataggtgggagg

SEQ ID NO: 90 - DNA, 70 bp, Homo sapiens
ttatcttcgcaccctgcctcctgcgctgccctgacaactcggacccgctgaccagcatgaaggacgtcct

SEQ ID NO: 91 - DNA, 70 bp, Homo sapiens
ttctgggctccaataggaagcagcatttacaacgtgtctggcttggtgggaggaagattgtcaattgagg

SEQ ID NO: 92 - DNA, 70 bp, Homo sapiens
tgcagctgccaccggcataggctttactgtcacatccgccccaggtcatgaaaatgttcactgcaatcat

SEQ ID NO: 93 - DNA, 69 bp, Homo sapiens
aacgatagcctagctttctaaagccacgctgtgtccctcaattacagagggtaggaatgggtatacctc

SEQ ID NO: 94 - DNA, 69 bp, Homo sapiens
agcaacaatgggagctgtgggagtgattttggccacactgtcaacatttgttagaaccagtcttttgaa

SEQ ID NO: 95 - DNA, 70 bp, Homo sapiens
gcaggtgtttgagaagtcccccctgcgggtgaagaacttcgggatctggctgcgctatgactcccggagc

SEQ ID NO: 96 - DNA, 70 bp, Homo sapiens
aggtggagagggtagagatgatccggcagcacctgtgccagtacacgcagctgcggcatgaaacagacat

SEQ ID NO: 97 - DNA, 70 bp, Homo sapiens
caaccagagtcacccagttggtgactgggaaagttaggattcagatcgaaattggactgtctttataacc

SEQ ID NO: 98 - DNA, 70 bp, Homo sapiens
caactggccccacaactcctgtcattgtaagttattctgccaccacctaacaggacggagtggagtgagt

SEQ ID NO: 99 - DNA, 70 bp, Homo sapiens
gccatggtcccaggcttcccaaaagtgtttgttggcaattattcccctaggctgagcctgctcatgtacc

SEQ ID NO: 100 - DNA, 70 bp, Homo sapiens
acattgagtctgacaactgttagttttctggttgtccaactaccatatgaagctagaaaatgcacaaacg

SEQ ID NO: 101 - DNA, 69 bp, Homo sapiens
cactgcccctaagctggggtggaaccggaatttgggtcaatacatccttttgtctcccaagggaagaga

SEQ ID NO: 102 - DNA, 69 bp, Homo sapiens
ggaggcgcaggatggcaccggcacatctaacatctacacttctctagctcagcctcacaggccaaagca

SEQ ID NO: 103 - DNA, 69 bp, Homo sapiens
aacctttttcattcaacattgtagggggcaagctttggtgcgccccctgctgaggagcagccccaggag

SEQ ID NO: 104 - DNA, 70 bp, Homo sapiens
gatgagctcttttaactcaagcgaaacttcaaggccagaagatcttgcctgttggtgatcatgctcctca

SEQ ID NO: 105 - DNA, 69 bp, Homo sapiens
aagctgatagccagacacgttctgatttctgcccttgttccagctttgacgtattatctgttgccttat

SEQ ID NO: 106 - DNA, 69 bp, Homo sapiens
actactctctcctttacctttacctttaccacagtgcagggctgactgaactgtcactgtgagatattt

SEQ ID NO: 107 - DNA, 69 bp, Homo sapiens
tgtttaagtccctgcttttatcctggtgcctgattggggtggggactgtcctactgtaacccctgtgaa

SEQ ID NO: 108 - DNA, 69 bp, Homo sapiens
ttgcagactcttaacgcaggaaggacttcaaacttctgctgagaccttggggtcaaggaacatttcatt

SEQ ID NO: 109 - DNA, 69 bp, Homo sapiens
gagctccctgcaagtgtaaatattaaggatgacctgtgcaaaattatacccacaccagcactagtggta

SEQ ID NO: 110 - DNA, 70 bp, Homo sapiens
gcatgccacaggggattctcctccttcatcctgtaaaggtcaacaataaaaaccaaattatggggctgct

SEQ ID NO: 111 - DNA, 69 bp, Homo sapiens
gaagactgacaaagtcatcctccgtctaccagagcgtgcacttgtgatcctaaaataagcttcatctcc

SEQ ID NO: 112 - DNA, 70 bp, Homo sapiens
aggtgccatcaaagttcctgagcaaggatacaccaaagttcctgtgccaggctacacaaagctaccagag

SEQ ID NO: 113 - DNA, 69 bp, Homo sapiens
tacagctgtaagtgcttggagggccatggaggtgtcctctgtgatgaagaggaggatctgtttaaccca

SEQ ID NO: 114 - DNA, 70 bp, Homo sapiens
agcaggagatcattaagaccacggagcagctcatcgaggccgtcaacaacggtgactttgaggcctacgc

SEQ ID NO: 115 - DNA, 70 bp, Homo sapiens
aaaaatgcacgtagctatggagtggggtttagctggaaaggtggccttccaacttcacgtcaacttctgg

SEQ ID NO: 116 - DNA, 69 bp, Homo sapiens
gcagttaagccagagccaaccaactcttccgtggaagtctctccagatatctaccagcaagtcagagat

SEQ ID NO: 117 - DNA, 70 bp, Homo sapiens
ctaagtttttatcatgggtcccatctgatagtggctttgggaacctctgtgaagtagagagccctccctt

SEQ ID NO: 118 - DNA, 69 bp, Homo sapiens
gctgtgaaaagttagggaagtgtctgacacctccagaatccattcccaagaagtgcctctggtcccact

SEQ ID NO: 119 - DNA, 69 bp, Homo sapiens
ctagagtcctactgtaggattgagcctgagataccggagtcctctcgccaggaacagcttgaggtacct

SEQ ID NO: 120 - DNA, 69 bp, Homo sapiens
cccacaaaacttcagtgtggtacaaggtggagaaagcatatcccaccaacctccagtgtcagggtccag

SEQ ID NO: 121 - DNA, 69 bp, Homo sapiens
gctatttccagagccagctcaaatcagggtccagtgggaactgaagagggcccaagtcggagctcggag

SEQ ID NO: 122 - DNA, 70 bp, Homo sapiens
acaaaagcatccatcccctcatagttaagtagccactggtgtcctgggaatttctggttggatttggtgc

SEQ ID NO: 123 - DNA, 69 bp, Homo sapiens
catagataggtatagtgggtttgcttgaggtggtaaggctttgctggaccctgttgcaggcaaaaggag

SEQ ID NO: 124 - DNA, 69 bp, Homo sapiens
gctgggattgggctaaggactgtggtcttatctgtccacatacagccaaaatgcctatccagaaatcca

SEQ ID NO: 125 - protein, 538 aa, Homo sapiens
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 126 - protein, 110 aa, Homo sapiens
MARGNQRELARQKNMKKTQEISKGKRKEDSLTASQRKQSSGGQKSESKMSAGPHLPLKAPRENPCFPLPAAGGSRYYLAYGSITPISAFVFVVFFSVFFPSFYEDFCCWI

SEQ ID NO: 127 - protein, 330 aa, Homo sapiens [sequence omitted]

SEQ ID NO: 128 - protein, 1669 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 129 - protein, 652 aa, Homo sapiens
MALVRGAEPAAGPSRWLPTHVQVTVLRARGLRGKSSGAGSTSDAYTVIQVGREKYSTSVVEKTHGCPEWREECSFELPPGALDGLLRAQEADAGPAPWAASSAAACELVLTTMHRSLIGVDKFLGQATVALDEVFGAGRAQHTQWYKLHSKPGKKEKERGEIEVTIQFTRNNLSAMFDLSMKDKPRSPFSKIRDKMKGKKKYDLESASAILPSSAIEDPDLGSLGKMGKAKGFFLRNKLRKSSLTQSNTSLGSDSTLSSASGSLAYQGPGAELLTRSPSRSSWLSTEGGRDSAQSPKLFTHKRTYSDEANQMRVAPPRALLDLQGHLDAASRSSLCVNGSHIYNEEPQGPVRHRSSISGSLPSSGSLQAVSSRFSEEGPRSTDDTWPRGSRSNSSSEAVLGQEELSAQAKVLAPGASHPGEEEGARLPEGKPVQVATPIVASSEAVAEKEGARKEERKPRMGLFHHHHQGLSRSELGRRSSLGEKGGPILGASPHHSSSGEGKAKSSWFGLREAKDPTQKPSPHPVKPLSAAPVEGSPDRKQSRSSLSIALSSGLEKLKTVTSGSIQPVTQAPQAGQMVDTKRLKDSAVLDQSAKYYNLTHDELISLLLQRERELSQRDEHVQELESYIDRLLVRIMETSPTLLQIPPGPPK

SEQ ID NO: 130 - protein, 641 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGDTKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 131 - protein, 258 aa, Homo sapiens
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 132 - protein, 465 aa, Homo sapiens
MRKGIQPALEQYLVTAGGGEGAAVVAAAAAASMDKRALLASPGFAAAAAAAAAPGAYIQILTTNTSTTSCSSSLQSGAVAAGPLLPSAPGAEQTAGSLLYTTPHGPSSRAGLLQQPPALGRGGSGGGGGPPAKRRLELGESGHQYLSDGLKTPKGKGRAALRSPDSPKTPKSPSEKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRLAYVTYQDIRKISGLKDQTVIVVKAPPETRLEVPDSIESLQIHLASTQGPIEVYLCPEETETHSPMKTNNQDHNGNIPKPASKDLASTNSGHSDCSVSMGNLSPLASPANLLQQTEDQIPSNLEGPFVNLLPPLLQEDYLLSLGEEEGISDLFDAYDLEKLPLVEDFMCS

SEQ ID NO: 133 - protein, 530 aa, Homo sapiens
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHASNKGMEHLLNMKCKNVVPVYDLLLEMLNAHVLRGCKSSITGSECSPAEDSKSKEGSQNPQSQ

SEQ ID NO: 134 - protein, 299 aa, Homo sapiens
MEEFDSEDFSTSEEDEDYVPSGGEYSEDDVNELVKEDEVDGEEQTQKTQGKKRKAQSIPARKRRQGGLSLEEEEEEDANSESEGSSSEEEDDAAEQEKGIGSEDARKKKEDELWASFLNDVGPKSKVPPSTQVKKGEETEETSSSKLLVKAEELEKPKETEKVKITKVFDFAGEEVRVTKEVDATSKEAKSFFKQNEKEKPQANVPSALPSLPAGSGLKRSSGMSSLLGKIGAKKQKMSTLEKSKLDWESFKEEEGIGEELAIHNRGKEGYIERKAFLDRVDHRQFEIERDLRLSKMKP

SEQ ID NO: 135 - protein, 189 aa, Homo sapiens
MRLSLPLLLLLLGAWAIPGGLGDRAPLTATAPQLDDEEMYSAHMPAHLRCDACRAVAYQMWQNLAKAETKLHTSNSGGRRELSELVYTDVLDRSCSRNWQDYGVREVDQVKRLTGPGLSEGPEPSISVMVTGGPWPTRLSRTCLHYLGEFGEDQIYEAHQQGRGALEALLCGGPQGACSEKVSATREEL

SEQ ID NO: 136 - protein, 1366 aa, Homo sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPAGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAHGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADHEFFVDIGPVCFK

SEQ ID NO: 137 - protein, 837 aa, Homo sapiens
MARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMGCRPFHGWTSLVLLAMAEDY

SEQ ID NO: 138 - protein, 379 aa, Homo sapiens
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 139 - protein, 2923 aa, Homo sapiens
MRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTHVFRVTAQDHGMPRRSALATLTILVTDTNDHDPVFEQQEYKESLRENLEVGYEVLTVRATDGDAPPNANILYRLLEGSGGSPSEVFEIDPRSGVIRTRGPVDREEVESYQLTVEASDQGRDPGPRSTTAAVFLSVEDDNDNAPQFSEKRYVVQVREDVTPGAPVLRVTASDRDKGSNAVVHYSIMSGNARGQFYLDAQTGALDVVSPLDYETTKEYTLRVRAQDGGRPPLSNVSGLVTVQVLDINDNAPIFVSTPFQATVLESVPLGYLVLHVQAIDADAGDNARLEYRLAGVGHDFPFTINNGTGWISVAAELDREEVDFYSFGVEARDHGTPALTASASVSVTVLDVNDNNPTFTQPEYTVRLNEDAAVGTSVVTVSAVDRDAHSVITYQITSGNTRNRFSITSQSGGGLVSLALPLDYKLERQYVLAVTASDGTRQDTAQIVVNVTDANTHRPVFQSSHYTVNVNEDRPAGTTVVLISATDEDTGENARITYFMEDSIPQFRIDADTGAVTTQAELDYEDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYVLRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSEFLFFNFLH

SEQ ID NO: 140 - protein, 394 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 141 - protein, 314 aa, Homo sapiens
MEDKRNIQIIEWEHLDKKKFYVFGVAMTMMIRVSVYPFTLIRTRLQVQKGKSLYHGTFDAFIKILRADGITGLYRGFLVNTFTLISGQCYVTTYELTRKFVADYSQSNTVKSLVAGGSASLVAQSITVPIDVVSQHLMMQRKGEKMGRFQVRGNPEGQGVVAFGQTKDIIRQILQADGLRGFYRGYVASLLTYIPNSAVWWPFYHFYAEQLSYLCPKECPHIVFQAVSGPLAAATASILTNPMDVIRTRVQVEGKNSIILTFRQLMAEEGPWGLMKGLSARIISATPSTIVIVVGYESLKKLSLRPELVDSRHW

SEQ ID NO: 142 - protein, 110 aa, Homo sapiens
MGASGSKARGLWPFASAAGGGGSEAAGAEQALVRPRGRAVPPFVFTRRGSMFYDEDGDLAHEFYEETIVTKNGQKRAKLRRVHKNLIPQGIVKLDHPRIHVDFPVILYEV

SEQ ID NO: 143 - protein, 911 aa, Homo sapiens
MEELQDDYEDMMEENLEQEEYEDPDIPESQMEEPAAHDTEATATDYHTTSHPGTHKVYVELQELVMDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPVPIRFLFVLLGPEAPHIDYTQLGRAAATLMSERVFRIDAYMAQSRGELLHSLEGFLDCSLVLPPTDAPSEQALLSLVPVQRELLRRRYQSSPAKPDSSFYKGLDLNGGPDDPLQQTGQLFGGLVRDIRRRYPYYLSDITDAFSPQVLAAVIFIYFAALSPAITFGGLLGEKTRNQMGVSELLISTAVQGILFALLGAQPLLVVGFSGPLLVFEEAFFSFCETNGLEYIVGRVWIGFWLILLVVLVVAFEGSFLVRFISRYTQEIFSFLISLIFIYETFSKLIKIFQDHPLQKTYNYNVLMVPKPQGPLPNTALLSLVLMAGTFFFAMMLRKFKNSSYFPGKLRRVIGDFGVPISILIMVLVDFFIQDTYTQKLSVPDGFKVSNSSARGWVIHPLGLRSEFPIWMMFASALPALLVFILIFLESQITTLIVSKPERKMVKGSGFHLDLLLVVGMGGVAALFGMPWLSATTVRSVTHANALTVMGKASTPGAAAQIQEVKEQRISGLLVAVLVGLSILMEPILSRIPLAVLFGIFLYMGVTSLSGIQLFDRILLLFKPPKYHPDVPYVKRVKTWRMHLFTGIQIICLAVLWVVKSTPASLALPFVLILTVPLRRVLLPLIFRNVELQCLDADDAKATFDEEEGRDEYDEVAMPV

SEQ ID NO: 144 - protein, 195 aa, Homo sapiens
MLLQSQTMGVSHSFTPKGITIPQREKPGHMYQNEDYLQNGLPTETTVLGFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 145 - protein, 44 aa, Homo sapiens
MSDKPDMAEIEKFDKSKLKKTETQEKNPLPSKETIEQEKQAGES

SEQ ID NO: 146 - protein, 620 aa, Homo sapiens
MRRSEVLAEESIVCLQKALNHLREIWELIGIPEDQRLQRTEVVKKHIKELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSGGYPGSAPLQRNFSINSVASTYSEFAKDPSLSDSSTVGLQRELSKASKSDATSGILNSTNIQS

SEQ ID NO: 147 - protein, 806 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 148 - protein, 367 aa, Homo sapiens
MEKKKMVTQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVDMQPTDMHSLLLQPQPPLLQPLQPLTVTVMAGCTQPTPTMPLPLPLAMELALWRVYTEVATADLPPTEVT

SEQ ID NO: 149 - protein, 1222 aa, Homo sapiens [sequence omitted]

SEQ ID NO: 150 - protein, 393 aa, Homo sapiens
MSCSESPAANSFLVDSLISSGRGEAGGGGGGAGGGGGGGYYAHGGVYLPPAADLPYGLQSCGLFPTLGGKRNEAASPGSGGGGGGLGPGAHGYGPSPIDLWLDAPRSCRMEPPDGPPPPPQQQPPPPPQPPQPAPQATSCSFAQNIKEESSYCLYDSADKCPKVSATAAELAPFPRGPPPDGCALGTSSGVPVPGYFRLSQAYGTAKGYGSGGGGAQQLGAGPFPAQPPGRGFDLPPALASGSADAARKERALDSPPPPTLACGSGGGSQGDEEAHASSSAAEELSPAPSESSKASPEKDSLGNSKGENAANWLTAKSGRKKRCPYTKHQTLELEKEFLFNMYLTRERRLEISRSVHLTDRQVKIWFQNRRMKLKKMNRENRIRELTANFNFS

SEQ ID NO: 151 - protein, 171 aa, Homo sapiens
MEQDNSPRKIQFTVPLLEPHLDPEAAEQIRRRRPTPATLVLTSDQSSPEIDEDRIPNPHLKSTLAMSPRQRKKMTRITPTMKELQMMVEHHLGQQQQGEEPEGAAESTGTQESRPPGIPDTEVESRLGTSGTAKKTAECIPKTHERGSKEPSTKEPSTHIPPLDSKGANSV

SEQ ID NO: 152 - protein, 2157 aa, Homo sapiens
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGVEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGPPAPALPCPGAPTPSPLPTVAAPPRRRPSSFVTVRVKTPRRTPIMPTANIKLPPGLPSHLPRWAPGAREAAAPVRRREPPARRPDQIHSVYITPGADLPVQGALEPLEEDGQPPGAKRRYSDPPTYCLPPASGQTNG

SEQ ID NO: 153 - protein, 724 aa, Homo sapiens
MKSAKGIENLAFVPSSPDILRRLSASPSQIEVSALSSDPQRENSQPQELQKPQEPQKSPEPSLPSAPPNVSEEKLRSLSLSEFEEGSYGWRNFHPQCLQRCNTPGGFLLHYCLLAVTQGIVVNGLVNISISTVEKRYEMKSSLTGLISSSYDISFCLLSLFVSFFGERGHKPRWLAFAAFMIGLGALVFSLPQFFSGEYKLGSLFEDTCVTTRNSTSCTSSTSSLSNYLYVFILGQLLLGAGGTPLYTLGTAFLDDSVPTHKSSLYIGTGYAMSILGPAIGYVLGGQLLTIYIDVAMGESTDVTEDDPRWLGAWWIGFLLSWIFAWSLIIPFSCFPKHLPGTAEIQAGKTSQAHQSNSNADVKFGKSIKDFPAALKNLMKNAVFMCLVLSTSSEALITTGFATFLPKFIENQFGLTSSFAATLGGAVLIPGAALGQILGGFLVSKFRMTCKNTMKFALFTSGVALTLSFVFMYAKCENEPFAGVSESYNGTGELGNLIAPCNANCNCSRSYYYPVCGDGVQYFSPCFAGCSNPVAHRKPKVYYNCSCIERKTEITSTAETFGFEAKAGKCETHCAKLPIFLCIFFIVIIFTFMAGTPITVSILRCVNHRQRSLALGIQFMVLRLLGTIPGPIIFGFTIDSTCILWDINDCGIKGACWIYDNIKMAHMLVAISVTCKVITMFFNGFAIFLYKPPPSATDVSFHKENAVVTNVLAEQDLNKIVKEG

SEQ ID NO: 154 - protein, 391 aa, Homo sapiens
MDSLGAVSTRLGFDLFKELKKTNDGNIFFSPVGILTAIGMVLLGTRGATASQLEEVFHSEKETKSSRIKAEEKEVIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 155 - protein, 201 aa, Homo sapiens
MRRAWILLTLGLVACVSAESRAELTSDKDMYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 156 - protein, 332 aa, Homo sapiens
MKLGRAVLGLLLLAPSVVQAVEPISLGLALAGVLTGYIYPRLYCLFAECCGQKRSLSREALQKDLDDNLFGQHLAKKIILNAVFGFINNPKPKKPLTLSLHGWTGTGKNFVSKIIAENIYEGGLNSDYVHLFVATLHFPHASNITLYKDQLQLWIRGNVSACARSIFIFDEMDKMHAGLIDAIKPFLDYYDLVDGVSYQKAMFIFLSNAGAERITDVALDFWRSGKQREDIKLKDIEHALSVSVFNNKNSGFWHSSLIDRNLIDYFVPFLPLEYKHLKMCIRVEMQSRGYEIDEDIVSRVAEEMTFFPKEERVFSDKGCKTVFTKLDYYYDD

SEQ ID NO: 157 - protein, 176 aa, Homo sapiens [sequence omitted]

SEQ ID NO: 158 - protein, 416 aa, Homo sapiens
MKPGMVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 159 - protein, 367 aa, Homo sapiens
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCAQVVGVGCVLDGVRYNNGQSFQPNCKYNCTCIDGAVGCTPLCLRVRPPRLWCPHPRRVSIPGHCCEQWVCEDDAKRPRKTAPRDTGAFDAVGEVEAWHRNCIAYTSPWSPCSTSCGLGVSTRISNVNAQCWPEQESRLCNLRPCDVDIHTLIKAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 160 - protein, 327 aa, Homo sapiens
MVRCDRGLQMLLTTAGAFAAFSLMAIAIGTDYWLYSSAHICNGTNLTMDDGPPPRRARGDLTHSGLWRVCCIEGIYKGHCFRINHFPEDNDYDHDSSEYLLRIVRASSVFPILSTILLLLGGLCIGAGRIYSRKNNIVLSAGILFVAAGLSNIIGIIVYISSNTGDPSDKRDEDKKNHYNYGWSFYFGALSFIVAETVGVLAVNIYIEKNKELRFKTKREFLKASSSSPYARMPSYRYRRRRSRSSSRSTEASPSRDVSPMGLKITGAIPMGELSMYTLSREPLKVTTAASYSPDQEASFLQVHDFFQQDLKEGFHVSMLNRRTTPV

SEQ ID NO: 161 - protein, 95 aa, Homo sapiens
MTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 162 - protein, 329 aa, Homo sapiens
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 163 - protein, 292 aa, Homo sapiens
MGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 164 - protein, 429 aa, Homo sapiens
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPR

SEQ ID NO: 165 - protein, 372 aa, Homo sapiens [sequence omitted]

SEQ ID NO: 166 - protein, 243 aa, Homo sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARSFGVEWIASWLVVTVPTILGLLLT

SEQ ID NO: 167 - protein, 770 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 168 - protein, 229 aa, Homo sapiens
MTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 169 - protein, 859 aa, Homo sapiens
MACLHETRTPSPSFGGFVSTLSEASMRKLDPDTSDCTPEKDLTPTHVLQLHEQDAGGPGGAAGSPESRASRVRADEVRLQCQSGSGFLEGLFGCLRPVWTMIGKAYSTEHKQQQEDLWEVPFEEILDLQWVGSGAQGAVFLGRFHGEEVAVKKVRDLKETDIKHLRKLKHPNIITFKGVCTQAPCYCILMEFCAQGQLYEVLRAGRPVTPSLLVDWSMGIAGGMNYLHLHKIIHRDLKSPNMLITYDDVVKISDFGTSKELSDKSTKMSFAGTVAWMAPEVIRNEPVSEKVDIWSFGVVLWELLTGEIPYKDVDSSAIIWGVGSNSLHLPVPSSCPDGFKILLRQCWNSKPRNRPSFRQILLHLDIASADVLSTPQETYFKSQAEWREEVKLHFEKIKSEGTCLHRLEEELVMRRREELRHALDIREHYERKLERANNLYMELNALMLQLELKERELLRREQALERRCPGLLKPHPSRGLLHGNTMEKLIKKRNVPQKLSPHSKRPDILKTESLLPKLDAALSGVGLPGCPKAPPSPGRSRRGKTRHRKASAKGSCGDLPGLRTAVPPHEPGGPGSPGGLGGGPSAWEACPPALRGLHHDLLLRKMSSSSPDLLSAALGSRGRGATGGAGDPGSPPPARGDTPPSEGSAPGSTSPDSPGGAKGEPPPPVGPGEGVGLLGTGREGTSGRGGSRAGSQHLTPAALLYRAAVTRSQKRGISSEEEEGEVDSEVELTSSQRWPQSLNMRQSLSTFSSENPSDGEEGTASEPSPSGTPEVGSTNTDERPDERSDDMCSQGSEIPLDPPPSEVIPGPEPSSLPIPHQELLRERGPPNSEDSDCDSTELDNSNSVDALRPPASLPP

SEQ ID NO: 170 - protein, 3664 aa, Homo sapiens
MVRETRHLWVGNLPENVREEKIIEHFKRYGRVESVKILPKRGSEGGVAAFVDFVDIKSAQKAHNSVNKMGDRDLRTDYNEPGTIPSAARGLDDTVSIASRSREVSGFRGGGGGPAYGPPPSLHAREGRYERRLDGASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERREERRASYDYNQDRTYYESVRTPGTYPEDSRRDYPARGREFYSEWETYQGDYYESRYYDDPREYRDYRNDPYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGELAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSTENSSQEISVEERTPTKASVPPDLPPPPQPAPVDEEPQARFRVHSIIESDPVTPPSDPSIPIPTLPSVTAAKLSPPVASGGIPHQSPPTKVTEWITRQEEPRAQSTPSPALPPDTKASDVDTSSSTLRKILMDPKYVSATSVTSTSVTTAIAEPVSAAPCLHEAPPPPVDSKKPLEEKTAPPVTNNSEIQASEVLVAADKEKVAPVIAPKITSVISRMPVSIDLENSQKITLAKPAPQTLTGLVSALTGLVNVSLVPVNALKGPVKGSVTTLKSLVSTPAGPVNVLKGPVNVLTGPVNVLTTPVNATVGTVNAAPGTVNAAASAVNATASAVTVTAGAVTAASGGVTATTGTVTMAGAVIAPSTKCKQRASANENSRFHPGSMPVIDDRPADAGSGAGLRVNTSEGVVLLSYSGQKTEGPQRISAKISQIPPASAMDIEFQQSVSKSQVKPDSVTASQPPSKGPQAPAGYANVATHSTLVLTAQTYNASPVISSVKADRPSLEKPEPIHLSVSTPVTQGGTVKVLTQGINTPPVLVHNQLVLTPSIVTTNKKLADPVTLKIETKVLQPANLGSTLTPHHPPALPSKLPTEVNHVPSGPSIPADRTVSHLAAAKLDAHSPRPSGPGPSSFPRASHPSSTASTALSTNATVMLAAGIPVPQFISSIHPEQSVIMPPHSITQTVSLSHLSQGEVRMNTPTLPSITYSIRPEALHSPRAPLQPQQIEVRAPQRASTPQPAPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPTPAPVPVPVPLPAPAPAPHGEARILTVTPSNQLQGLPLTPPVVVTHGVQIVHSSGELFQEYRYGDIRTYHPPAQLTHTQFPAASSVGLPSRTKTAAQGPPPEGEPLQPPQPVQSTQPAQPAPPCPPSQLGQPGQPPSSKMPQVSQEAKGTQTGVEQPRLPAGPANRPPEPHTQVQRAQAETGPTSFPSPVSVSMKPDLPVSLPTQTAPKQPLFVPTTSGPSTPPGLVLPHTEFQPAPKQDSSPHLTSQRPVDMVQLLKKYPIVWQGLLALKNDTAAVQLHFVSGNNVLAHRSLPLSEGGPPLRIAQRMRLEATQLEGVARRMTVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 171 - protein, 526 aa, Homo sapiens
MVAKDYPFYLTVKRANCSLELPPASGPAKDAEEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 172 - protein, 517 aa, Homo sapiens
AGITGARGLAGPPGMPGPRGSPGPQGVKGESGKPGANGLSGERGPPGPQGLPGLAGTAGEPGRDGNPGSYGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSANGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 173 - protein, 98 aa, Homo sapiens
MMCGAPSATQPATAETQHIADQVRSQLEEKENKKFPVFKAVSFKSQVVAGTNYFIKVHVGDEDFVHLRVFQSLPHENKPLTLSNYQTNKAKHDELTYF

SEQ ID NO: 174 - protein, 169 aa, Homo sapiens
MSSYQQKQTFTPPPQLQQQQVKQPSQPPPQEIFVPTTKEPCHSKVPQPGNTKIPEPGCTKVPEPGCTKVPEPGCTKVPEPGCTKVPEPGCTKVPEPGCTKVPEPGYTKVPEPGSIKVPDQGFIKFPEPGAIKVPEQGYTKVPVPGYTKLPEPCPSTVTPGPAQQKTKQK

SEQ ID NO: 175 - protein, 1529 aa, Homo sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSAKEQYFIPGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 176 - protein, 666 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKAPRVPDILSSVRRGSGAPEAEGPLPCPSPAPFSPLPAPSPRISDILNSVRRGSGTPEAEGPLSAGPPPCLSPALLGPLSSPSPRISDILNSVRRGSGTPEAEGPSPVGPPPCPSPTIPGPLPTPSRKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 177 - protein, 520 aa, Homo sapiens
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 178 - protein, 733 aa, Homo sapiens
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 179 - protein, 434 aa, Homo sapiens
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKNNPWLCTE

SEQ ID NO: 180 - protein, 522 aa, Homo sapiens
MAAVVAATRWWQLLLVLSAAGMGASGAPQPPNILLLLMDDMGWGDLGVYGEPSRETPNLDRMAAEGLLFPNFYSANPLCSPSRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLCGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFCPGQNVSGVTTHNLEDHTKLPLIFHLGRDPGERFPLSFASAEYQEALSRITSVVQQHQEALVPAQPQLNVCNWAVMNWAPPGCEKLGKCLTPPESIPKKCLWSH

SEQ ID NO: 181 - protein, 778 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 182 - protein, 346 aa, Homo sapiens
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAGKTQLALQLCLAVQFPRQHGGLEAGAVYICTEDAFPHKRLQQLMAQQPRLRTDVPGELLQKLRFGSQIFIEHVADVDTLLECVNKKVPVLLSRGMARLVVIDSVAAPFRCEFDSQASAPRARHLQSLGATLRELSSAFQSPVLCINQVTEAMEEQGAAHGPLGFWDERVSPALGITWANQLLVRLLADRLREEEAALGCPARTLRVLSAPHLPPSSCSYTISAEGVRGTPGTQSH

SEQ ID NO: 183 - protein, 239 aa, Homo sapiens
MGLIWLLLLSLLEPGWPAAGPGARLRRDAGGRGGVYEHLGGAPRRRKLYCATKYHLQLHPSGRVNGSLENSAYSILEITAVEVGIVAIRGLFSGRYLAMNKRGRLYASEHYSAECEFVERIHELGYNTYASRLYRTVSSTPGARRQPSAERLWYVSVNGKGRPRRGFKTRRTQKSSLFLPRVLDHRDHEMVRQLQSGLPRPPGKGVQPRRRRQKQSPDNLEPSHVQASRLGSQLEASAH

SEQ ID NO: 184 - protein, 120 aa, Homo sapiens
MSSSAGSGHQPSQSRAIPTRTVAISDAAQLPHDYCTTPGGTLFSTTPGGTRIIYDRKFLLDRRNSPMAQTPPCHLPNIPGVTSPGTLIEDSKVEVNNLNNLNNHDRKHAVGDDAQFEMDI

SEQ ID NO: 185 - protein, 792 aa, Homo sapiens
MHVIKRDGRQERVMFDKITSRIQKLCYGLNMDFVDPAQITMKVIQGLYSGVTTVELDTLAAETAATLTTKHPDYAILAARIAVSNLHKETKKVFSDVMEDLYNYINPHNGKHSPMVAKSTLDIVLANKDRLNSAIIYDRDFSYNYFGFKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 186 - protein, 277 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

The invention claimed is:

1. A method for determining whether a human subject has an increased likelihood of having esophageal cancer, comprising:
   (1) obtaining a test sample of esophageal tissue, or peripheral lymph nodes or another organ suspected of metastasis from esophageal cancer cells, from the subject;
   (2) selecting a set of the EYA2, SERF1A and IGHG1 genes;
   (3) assaying the expression level of EYA2, SERF1A, and IGHG1 genes in the test sample obtained from the subject and assaying normal esophageal tissue sample by contacting said samples to a composition, a kit, a DNA chip, or a combination thereof, wherein the composition, kit or DNA chip comprises three polynucleotide probes selected from the group consisting of the following polynucleotides and fragments (a) to (f), and mixtures thereof, wherein the polynucleotides and fragments (a) to (f), and mixtures thereof hybridize to EYA2, SERF1A and IGHG1 genes, thereby obtaining expression levels of EYA2, SERF1A and IGHG1:

(a) a polynucleotide consisting of a cDNA sequence derived from the nucleotide sequence of any of SEQ ID NOs: 1 to 3, or a polynucleotide consisting of at least 50 contiguous nucleotides of the cDNA sequence;

(b) a polynucleotide comprising a cDNA sequence derived from the nucleotide sequence of any of SEQ ID NOs: 1 to 3;

(c) a polynucleotide consisting of a nucleotide sequence fully complementary to a cDNA sequence derived from the nucleotide sequence of any of SEQ ID NOs: 1 to 3, or a polynucleotide consisting of at least 50 contiguous nucleotides complementary to the cDNA sequence;

(d) a polynucleotide comprising a nucleotide sequence fully complementary to a cDNA sequence derived from the nucleotide sequence of any of SEQ ID NOs: 1 to 3;

(e) a polynucleotide hybridizing, under stringent conditions, to any of polynucleotides (a) to (d) or a fragment thereof comprising at least 50 continuous nucleotides, wherein the stringent conditions comprise hybridization in a solution containing 3-4×SSC and 0.1-0.5% SDS at 30-50° C. for 1-24 hours and then successive washes with a solution containing 3×SSC and 0.1% SDS at 30° C., a solution containing 0.3×SSC and 0.1% SDS at 42° C., and a solution containing 0.1×SSC at 30° C.; and (f) a polynucleotide which is a fragment comprising at least 50 continuous nucleotides of any one of the EYA2, SERF1A, and IGHG1 genes or cDNAs, or a polynucleotide fully complementary to the fragment;

(4) detecting hybridization of the set of polynucleotide probes to target nucleic acids in the test sample to thereby detect the expression level of EYA1, SERF1A and IGHG1 genes, and (5) determining that the human subject has an increased likelihood of having esophageal cancer based on a higher expression level of the EYA2, SERF1A and IGHG1 genes in the test sample as compared to the expression level of the EYA2, SERF1A and IGHG1 genes in the normal esophageal tissue sample.

2. The method according to claim 1, wherein the samples are exposed to the DNA chip, thereby obtaining expression levels of EYA2, SERF1A and IGHG1.

3. A method for determining the presence or absence of esophageal cancer cells in a test sample from a human subject comprising the steps of:

(1) measuring in vitro expression levels of target nucleic acids in a plurality of esophageal cancer tissues or normal esophageal tissues, wherein the target nucleic acids comprise at least the EYA2, SERF1A and IGHG1 genes;

(2) preparing a discriminant from a support vector machine made using as training samples the expression levels of the target nucleic acids determined in step (1);

(3) selecting a set of the EYA2, SERF1A and IGHG1 genes;

(4) measuring in vitro expression levels of the target nucleic acids in a test sample obtained from the esophagus of the subject in the same manner as in step (1) to thereby determine the expression levels of the EYA2, SERF1A and IGHG1 genes;

(5) assigning the expression levels of the EYA2, SERF1A, and IGHG1 genes determined in step (4) to the discriminant prepared in step (2); and, (6) determining the presence or absence of esophageal cancer cells in the test sample from the human subject by classifying the test sample into either (+1), which indicates the presence of esophageal cancer cells in the test sample, or (−1), which indicates the absence of esophageal cancer cells in the test sample, wherein the expression levels are measured in steps (1) and (4) by detecting hybridization of the target nucleic acids to a set of three polynucleotide probes and wherein said polynucleotide probes are selected from the group consisting of the following polynucleotides and fragments (a)-(f):

(a) a polynucleotide consisting of a cDNA sequence derived from the nucleotide sequence of any of SEQ ID NOs: 1 to 3, or a polynucleotide consisting of at least 50 contiguous nucleotides of the cDNA sequence;

(b) a polynucleotide comprising a cDNA sequence derived from the nucleotide sequence of any of SEQ ID NOs: 1 to 3;

(c) a polynucleotide consisting of a nucleotide sequence fully complementary to a cDNA sequence derived from the nucleotide sequence of any of SEQ ID NOs: 1 to 3, or a polynucleotide consisting of at least 50 contiguous nucleotides complementary to the cDNA sequence;

(d) a polynucleotide comprising a nucleotide sequence fully complementary to a cDNA sequence derived from the nucleotide sequence of any of SEQ ID NOs: 1 to 3;

(e) a polynucleotide hybridizing, under stringent conditions, to any of polynucleotides (a) to (d) or a fragment thereof comprising at least 50 continuous nucleotides, wherein the stringent conditions comprise hybridization in a solution containing 3-4×SSC and 0.1-0.5% SDS at 30-50° C. for 1-24 hours and then successive washes with a solution containing 3×SSC and 0.1% SDS at 30° C., a solution containing 0.3×SSC and 0.1% SDS at 42° C., and a solution containing 0.1×SSC at 30° C.; and (f) a polynucleotide which is a fragment comprising at least 50 continuous nucleotides of any one of the EYA2, SERF1A, and IGHG1 genes or cDNAs, or a polynucleotide fully complementary to the fragment.

4. The method according to claim 1 or 3, wherein the fragment is a polynucleotide comprising at least 60 continuous nucleotides.

5. The method according to claim 1 or 3, wherein the polynucleotide consists of the nucleotide sequence of any of SEQ ID NOs: 63 to 65, or a polynucleotide consisting of a nucleotide sequence fully complementary to the nucleotide sequence of any of SEQ ID NOs: 63 to 65.

6. The method according to claim 1 or 3, wherein the polynucleotides are packaged in different containers separately or, optionally, in combination.

7. The method according to claim 1 or 3, wherein the three polynucleotide probes consist of:

(i) the nucleotide sequences of each of SEQ ID NOs: 63 to 65;

(ii) a nucleotide sequence having at least 95% sequence identity to SEQ ID NO: 63, a nucleotide sequence having at least 95% sequence identity to SEQ ID NO: 64, and a nucleotide having at least 95% sequence identity to SEQ ID NO: 65; or (iii) nucleotide sequences fully complementary to the nucleotide sequences of SEQ ID NOs: 63 to 65.

8. A method for identifying in vitro human cells as being esophageal cancer cells, comprising:

determining the amount of an expression product of each of the EYA2, SERF1A, and IGHG1 genes or the complement thereof, (i) in a sample human tissue suspected of being cancerous and comprising esophageal tissue, peripheral lymph nodes, or tissue from another organ suspected of metastasis from esophageal cancer cells, and (ii) in normal human tissue comprising esophageal tissue, peripheral lymph nodes, or tissue from an organ corresponding to the tissue suspected of metastasis from esophageal cancer cells, wherein said expression product is an mRNA molecule, and wherein the amount of said expression product is determined by amplification of the expression product and hybridization of the expression product to at least one probe or primer for each of the EYA2, SERF1, and IGHG1 genes, wherein said at least one probe or primer comprises at least 50 contiguous nucleotides from and specific to a cDNA sequence derived from the nucleotide sequence of one of SEQ ID NOs: 1-3 or its complement;

comparing the determined amounts of said expression products; and identifying the human cells in the sample human tissue as being esophageal cancer cells based on the determination that the amount of the expression product of each of the EYA2, SERF1A, and IGHG1 genes or the complement thereof is higher in the sample human tissue as compared to that in the normal human tissue.

* * * * *